US010465205B2

(12) United States Patent
Bowen et al.

(10) Patent No.: US 10,465,205 B2
(45) Date of Patent: Nov. 5, 2019

(54) INSECT INHIBITORY PROTEINS

(71) Applicant: MONSANTO TECHNOLOGY LLC, St. Louis, MO (US)

(72) Inventors: David J. Bowen, Wildwood, MO (US); Catherine A. Chay, Ballwin, MO (US); Todd A. Ciche, San Diego, CA (US); Stanislaw Flasinski, Ballwin, MO (US); Arlene R. Howe, Clarkson Valley, MO (US); Krishnakumar Sridharan, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 15/944,114

(22) Filed: Apr. 3, 2018

(65) Prior Publication Data
US 2018/0291395 A1   Oct. 11, 2018

Related U.S. Application Data

(60) Provisional application No. 62/480,614, filed on Apr. 3, 2017.

(51) Int. Cl.
| C12N 15/82 | (2006.01) |
| C07K 14/195 | (2006.01) |
| C07K 14/32 | (2006.01) |
| A01N 37/46 | (2006.01) |
| A01N 63/02 | (2006.01) |

(52) U.S. Cl.
CPC ......... *C12N 15/8286* (2013.01); *A01N 37/46* (2013.01); *A01N 63/02* (2013.01); *C07K 14/195* (2013.01); *C07K 14/32* (2013.01)

(58) Field of Classification Search
None
See application file for complete search history.

(56) References Cited

U.S. PATENT DOCUMENTS

| 4,771,131 A | 9/1988 | Herrnstadt et al. | |
| 6,210,953 B1 | 4/2001 | Osman et al. | |
| 8,461,416 B2 | 6/2013 | Niblett | |
| 2011/0030096 A1* | 2/2011 | Sampson ............. | C07K 14/325 800/279 |
| 2013/0167268 A1* | 6/2013 | Narva ................. | C07K 14/325 800/302 |
| 2013/0247254 A1* | 9/2013 | Lira ..................... | C07K 14/325 800/302 |
| 2015/0274786 A1* | 10/2015 | Bowen ............... | C12N 15/8286 800/302 |

FOREIGN PATENT DOCUMENTS

| WO | WO 1999/035910 A2 | 7/1999 |
| WO | WO 2005/082077 A2 | 9/2005 |
| WO | WO 2011/014749 A1 | 2/2011 |

OTHER PUBLICATIONS

Tounsi et al. (2003) J. Appl Microbiol 95:23-28.*
de Maagd et al. (1999) Appl Environ Microbiol 65:4369-74.*
Angsuthanasombat et al. (2001) J Biochem Mol Biol 34:402-07.*
Aronson & Shai (2001) FEMS Microbiol Lett 195:1-8.*
de Maagd et al. (2001) Trends Genet 17:193-99.*
Guo et al. (2004) Proc Natl Acad Sci USA 101:9205-10.*
Olsen et al. (2005) Trends Plant Sci 10(2):79-87.*
Fourgoux-Nicol et al. (1999) Plant Mol Biol 40:857-72.*
International Search Report and Written Opinion regarding International Application No. PCT/US2018/025867, dated Aug. 9, 2018.
Ribeiro et al., "Transgenic cotton expressing Cry10Aa toxin confers high resistance to the cotton boil weevil," Plant Biotechnology Journal, Jan. 12, 2017 (Jan. 12, 2017), vol. 15, Iss. 8, pp. 997-1009. entire document.

* cited by examiner

Primary Examiner — Russell T Boggs
(74) Attorney, Agent, or Firm — Dentons US LLP; Carine Marie Doyle, Esq.

(57) ABSTRACT

A pesticidal protein class exhibiting toxic activity against Coleopteran and Lepidopteran pest species is disclosed, and includes, but is not limited to, TIC7040, TIC7042, TIC7381, TIC7382, TIC7383, TIC7386, TIC7388, and TIC7389. DNA constructs are provided which contain a recombinant nucleic acid sequence encoding the TIC7040, TIC7042, TIC7381, TIC7382, TIC7383, TIC7386, TIC7388, and TIC7389 pesticidal proteins. Transgenic plants, plant cells, seed, and plant parts resistant to Coleopteran and Lepidopteran infestation are provided which contain recombinant nucleic acid sequences encoding the TIC7040, TIC7042, TIC7381, TIC7382, TIC7383, TIC7386, TIC7388, and TIC7389 pesticidal proteins of the present invention. Methods for detecting the presence of the recombinant nucleic acid sequences or the proteins of the present invention in a biological sample, and methods of controlling Coleopteran and Lepidopteran species pests using the TIC7040, TIC7042, TIC7381, TIC7382, TIC7383, TIC7386, TIC7388, and TIC7389 pesticidal proteins are also provided.

26 Claims, No Drawings

Specification includes a Sequence Listing.

INSECT INHIBITORY PROTEINS

REFERENCE TO RELATED APPLICATION

This application claims the benefit of U.S. Provisional Application No. 62/480,614, filed Apr. 3, 2017, which is herein incorporated by reference in its entirety.

INCORPORATION OF SEQUENCE LISTING

The file named "MONS443US-sequence_listing.txt" containing a computer-readable form of the Sequence Listing was created on Apr. 2, 2018. This file is 669,339 bytes (measured in MS-Windows®) is contemporaneously filed by electronic submission (using the United States Patent Office EFS-Web filing system), and is incorporated into this application by reference in its entirety.

FIELD OF THE INVENTION

The invention generally relates to the field of insect inhibitory proteins. A novel class of proteins exhibiting insect inhibitory activity against agriculturally-relevant pests of crop plants and seeds is disclosed. In particular, the disclosed protein are insecticidally active against agriculturally-relevant pests of crop plants and seeds, particularly Coleopteran and Lepidopteran species of insect pests. Plants, plant parts, and seeds containing a recombinant polynucleotide construct encoding one or more of the disclosed toxin proteins are provided.

BACKGROUND OF THE INVENTION

Improving crop yield from agriculturally significant plants including, among others, corn, soybean, sugarcane, rice, wheat, vegetables, and cotton, has become increasingly important. In addition to the growing need for agricultural products to feed, clothe and provide energy for a growing human population, climate-related effects and pressure from the growing population to use land other than for agricultural practices are predicted to reduce the amount of arable land available for farming. These factors have led to grim forecasts of food security, particularly in the absence of major improvements in plant biotechnology and agronomic practices. In light of these pressures, environmentally sustainable improvements in technology, agricultural techniques, and pest management are vital tools to expand crop production on the limited amount of arable land available for farming.

Insects, particularly insects within the Lepidoptera and Coleoptera orders, are considered a major cause of damage to field crops, thereby decreasing crop yields over infested areas. Historically, the intensive application of synthetic chemical insecticides was relied upon as the pest control agent in agriculture. Concerns for the environment and human health, in addition to emerging resistance issues, stimulated the research and development of biological pesticides. This research effort led to the progressive discovery and use of various entomopathogenic microbial species, including bacteria.

The biological control paradigm shifted when the potential of entomopathogenic bacteria, especially bacteria belonging to the genus *Bacillus*, was discovered and developed as a biological pest control agent. Strains of the bacterium *Bacillus thuringiensis* (Bt) have been used as a source for pesticidal proteins since it was discovered that Bt strains show a high toxicity against specific insects. Bt strains are known to produce delta-endotoxins that are localized within parasporal crystalline inclusion bodies at the onset of sporulation and during the stationary growth phase (e.g., Cry proteins), and are also known to produce secreted insecticidal protein. Upon ingestion by a susceptible insect, delta-endotoxins as well as secreted toxins exert their effects at the surface of the midgut epithelium, disrupting the cell membrane, leading to cell disruption and death. Genes encoding insecticidal proteins have also been identified in bacterial species other than Bt, including other *Bacillus* and a diversity of additional bacterial species, such as *Brevibacillus laterosporus, Lysinibacillus sphaericus* ("Ls" formerly known as *Bacillus sphaericus*) and *Paenibacillus popilliae*.

Crystalline and secreted soluble insecticidal toxins are highly specific for their hosts and have gained worldwide acceptance as alternatives to chemical insecticides. For example, insecticidal toxin proteins have been employed in various agricultural applications to protect agriculturally important plants from insect infestations, decrease the need for chemical pesticide applications, and increase yields. Insecticidal toxin proteins are used to control agriculturally-relevant pests of crop plants by mechanical methods, such as spraying to disperse microbial formulations containing various bacteria strains onto plant surfaces, and by using genetic transformation techniques to produce transgenic plants and seeds expressing insecticidal toxin protein.

The use of transgenic plants expressing insecticidal toxin proteins has been globally adapted. For example, in 2012, 26.1 million hectares were planted with transgenic crops expressing Bt toxins (James, C., Global Status of Commercialized Biotech/GM Crops: 2012. ISAAA Brief No. 44). The global use of transgenic insect-protected crops and the limited number of insecticidal toxin proteins used in these crops has created a selection pressure for existing insect alleles that impart resistance to the currently-utilized insecticidal proteins.

The development of resistance in target pests to insecticidal toxin proteins creates the continuing need for discovery and development of new forms of insecticidal toxin proteins that are useful for managing the increase in insect resistance to transgenic crops expressing insecticidal toxin proteins. New protein toxins with improved efficacy and which exhibit control over a broader spectrum of susceptible insect species will reduce the number of surviving insects which can develop resistance alleles. In addition, the use in one plant of two or more transgenic insecticidal toxin proteins toxic to the same insect pest and displaying different modes of action reduces the probability of resistance in any single target insect species.

Thus, the inventors herein disclose a novel protein toxin family from *Bacillus* laterosporous along with similar toxin proteins, variant proteins, and exemplary recombinant proteins that exhibit insecticidal activity against target Lepidopteran and Coleopteran, particularly against Western Corn Rootworm and Northern Corn Rootworm.

SUMMARY OF THE INVENTION

Disclosed herein is a novel group of pesticidal proteins with insect inhibitory activity (toxin proteins), referred to herein as TIC7040-related protein toxins, which are shown to exhibit inhibitory activity against one or more pests of crop plants. The TIC7040 protein and proteins in the TIC7040 protein toxin class can be used alone or in combination with other insecticidal proteins and toxic agents in formulations and in planta, thus providing alternatives to insecticidal proteins and insecticide chemistries currently in use in agricultural systems.

In one embodiment, disclosed in this application is a recombinant nucleic acid molecule comprising a heterologous promoter operably linked to a polynucleotide segment encoding a pesticidal protein or fragment thereof, wherein: (a) said pesticidal protein comprises the amino acid sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127; or (b) said pesticidal protein comprises an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ ID NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83; or (c) said polynucleotide segment hybridizes to a polynucleotide having the nucleotide sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, OR SEQ ID NO:126; or (d) said recombinant nucleic acid molecule is in operable linkage with a vector, and said vector is selected from the group consisting of a plasmid, phagemid, bacmid, cosmid, and a bacterial or yeast artificial chromosome. The recombinant nucleic acid molecule can comprise a sequence that functions to express the pesticidal protein in a plant; or is expressed in a plant cell to produce a pesticidally effective amount of pesticidal protein.

In another embodiment of this application are host cells comprising a recombinant nucleic acid molecule of the application, wherein the host cell is selected from the group consisting of a bacterial and a plant cell. Contemplated host cells include *Agrobacterium, Rhizobium, Bacillus, Brevibacillus, Escherichia, Pseudomonas, Klebsiella, Pantoea,* and *Erwinia*. In certain embodiments said *Bacillus* species is *Bacillus cereus* or *Bacillus thuringiensis*, said *Brevibacillus* is *Brevibacillus laterosperus*, or said *Escherichia* is *Escherichia coli*. Contemplated plant host cells include a dicotyledonous cell and a monocotyledonous cell. Further contemplated plant host cells include an alfalfa, banana, barley, bean, broccoli, cabbage, Brassica, carrot, cassava, castor, cauliflower, celery, chickpea, Chinese cabbage, citrus, coconut, coffee, corn, clover, cotton (*Gossypium* sp.), a cucurbit, cucumber, Douglas fir, eggplant, eucalyptus, flax, garlic, grape, hops, leek, lettuce, Loblolly pine, millets, melons, nut, oat, olive, onion, ornamental, palm, pasture grass, pea, peanut, pepper, pigeonpea, pine, potato, poplar, pumpkin, Radiata pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and wheat plant cell.

In yet another embodiment, the pesticidal protein exhibits activity against Coleopteran insect, including Western Corn Rootworm, Southern Corn Rootworm, Northern Corn Rootworm, Mexican Corn Rootworm, Brazilian Corn Rootworm, Colorado Potato Beetle, Brazilian Corn Rootworm complex consisting of *Diabrotica viridula* and *Diabrotica speciosa*, Crucifer Flea Beetle, Striped Flea Beetle, and Western Black Flea Beetle.

In another embodiment, the pesticidal protein exhibits activity against a Lepidopteran insect, including Black Cutworm, Corn Earworm, Diamondback Moth, European Corn Borer, Fall Armyworm, Southern Armyworm, Soybean Looper, Southwestern Corn Borer, Tobacco Budworm, Velvetbean Caterpillar, Sugarcane Borer, Lesser Cornstalk Borer, Black Armyworm, Beet Armyworm, Old World Bollworm, Oriental leaf Worm, or Pink Bollworm.

Also contemplated in this application are plants comprising a recombinant nucleic acid molecule comprising a heterologous promoter operably linked to a polynucleotide segment encoding a pesticidal protein or fragment thereof, wherein: (a) said pesticidal protein comprises the amino acid sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127; or (b) said pesticidal protein comprises an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ ID NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83; or (c) said polynucleotide segment hybridizes under stringent hybridization conditions to the compliment of the nucleotide sequence of to SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, OR SEQ ID NO:126; or (d) said plant exhibits a detectable amount of said pesticidal protein. In certain embodiments the pesticidal protein comprises SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127. In one embodiment, the plant is either a monocot or a dicot. In another embodiment, the plant is selected from the group consisting of an alfalfa, banana, barley, bean, broccoli, cabbage, Brassica, carrot, cassava, castor, cauliflower, celery, chickpea, Chinese cabbage, citrus, coconut, coffee, corn, clover, cotton, a cucurbit, cucumber, Douglas fir, eggplant, eucalyptus, flax, garlic, grape, hops, leek, lettuce, Loblolly pine, millets, melons, nut, oat, olive, onion, ornamental, palm, pasture grass, pea, peanut, pepper, pigeon pea, pine, potato, poplar, pumpkin, Radiata pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and wheat.

In further embodiments, seeds comprising the recombinant nucleic acid molecules are disclosed.

In another embodiment, an insect inhibitory composition comprising the recombinant nucleic acid molecules disclosed in this application are contemplated. The insect inhibitory composition can further comprise a nucleotide sequence encoding at least one other pesticidal agent that is different from said pesticidal protein. The at least one other pesticidal agent is selected from the group consisting of an insect inhibitory protein, an insect inhibitory dsRNA molecule, and an ancillary protein. The at least one other pesticidal agent in the insect inhibitory composition exhibits activity against one or more pest species of the orders Lepidoptera, Coleoptera, or Hemiptera. The at least one other pesticidal agent in the insect inhibitory composition is in one embodiment selected from the group consisting of: a Cry1A, Cry1Ab, Cry1Ac, Cry1A.105, Cry1Ae, Cry1B, Cry1C, Cry1C variants, Cry1D, Cry1E, Cry1F, Cry1A/F chimeras, Cry1G, Cry1H, Cry1I, Cry1J, Cry1K, Cry1L, Cry2A, Cry2Ab, Cry2Ae, Cry3, Cry3A variants, Cry3B, Cry4B, Cry6, Cry7, Cry8, Cry9, Cry15, Cry34, Cry35, Cry43A, Cry43B, Cry51Aa1, ET29, ET33, ET34, ET35, ET66, ET70, TIC400, TIC407, TIC417, TIC431, TIC800, TIC807, TIC834, TIC853, TIC900, TIC901, TIC1201, TIC1415, TIC2160, TIC3131, TIC836, TIC860, TIC867, TIC869, TIC1100, VIP3A, VIP3B, VIP3Ab, AXMI-AXMI-, AXMI-88, AXMI-97, AXMI-102, AXMI-112, AXMI-117, AXMI-100, AXMI-115, AXMI-113, and AXMI-005, AXMI134, AXMI-150, AXMI-171, AXMI-184, AXMI-196, AXMI-204, AXMI-207, AXMI-209, AXMI-205, AXMI-218, AXMI-220, AXMI-221z, AXMI-222z, AXMI-223z, AXMI-224z and AXMI-225z, AXMI-238, AXMI-270, AXMI-279, AXMI-345, AXMI-335, AXMI-R1 and variants thereof, IP3 and variants thereof, DIG-3, DIG-5, DIG-10, DIG-657 DIG-11, Cry71Aa1, Cry72Aa1, PHI-4 variants, PIP-72 variants, PIP-45 variants, PIP-64 variants, PIP-74 variants, PIP-75 variants, PIP-77 variants, Axmi422, Dig-305, Axmi440, PIP-47 variants, Axmi281, BT-009, BT-0012, BT-0013, BT-0023, BT0067, BT-0044, BT-0051, BT-0068, BT-0128, DIG-17, DIG-90, DIG-79, Cry1JP578V, Cry1JPS1, and Cry1 JPS1P578V.

Commodity products comprising a detectable amount of the recombinant nucleic acid molecules disclosed in this application are contemplated. Such commodity products include commodity corn bagged by a grain handler, corn flakes, corn cakes, corn flour, corn meal, corn syrup, corn oil, corn silage, corn starch, corn cereal, and the like, and corresponding cotton commodity products such as whole or processed cotton seed, cotton oil, lint, seeds and plant parts processed for feed or food, fiber, paper, biomasses, and fuel products such as fuel derived from cotton oil or pellets derived from cotton gin waste, and corresponding soybean commodity products such as whole or processed soybean seed, soybean oil, soybean protein, soybean meal, soybean flour, soybean flakes, soybean bran, soybean milk, soybean cheese, soybean wine, animal feed comprising soybean, paper comprising soybean, cream comprising soybean, soybean biomass, and fuel products produced using soybean plants and soybean plant parts, and corresponding rice, wheat, sorghum, pigeon pea, peanut, fruit, melon, and vegetable commodity products including where applicable, juices, concentrates, jams, jellies, marmalades, and other edible forms of such commodity products containing a detectable amount of such polynucleotides and or polypeptides of this application.

Also contemplated in this application is a method of producing seed comprising the recombinant nucleic acid molecules disclosed in this application. The method comprises planting at least one of the seed comprising the recombinant nucleic acid molecules disclosed in this application; growing plant from the seed; and harvesting seed from the plants, wherein the harvested seed comprises the recombinant nucleic acid molecules in this application.

In another illustrative embodiment, a plant resistant to insect infestation is provided, wherein the cells of said plant comprise: (a) a recombinant nucleic acid molecule encoding an insecticidally effective amount of a pesticidal protein as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127; or (b) an insecticidally effective amount of a protein comprising an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83.

Also disclosed in this application are methods for controlling a Coleopteran or Lepidopteran species pest, and controlling a Coleopteran or Lepidopteran species pest infestation of a plant, particularly a crop plant. The method comprises, in one embodiment, (a) contacting the pest with an insecticidally effective amount of one or more pesticidal proteins as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127; or (b) contacting the pest with an insecticidally effective amount of one or more pesticidal proteins comprising an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83.

Further provided herein is a method of detecting the presence of a recombinant nucleic acid molecule comprising a polynucleotide segment encoding a pesticidal protein or fragment thereof, wherein: (a) said pesticidal protein comprises the amino acid sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127; or (b) said pesticidal protein comprises an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83; or (c) said polynucleotide segment hybridizes to a polynucleotide having the nucleotide sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, or SEQ ID NO:126. In one embodiment of the invention, the method comprises contacting a sample of nucleic acids with a nucleic acid probe that hybridizes under stringent hybridization conditions with genomic DNA from a plant comprising a polynucleotide segment encoding a pesticidal protein or fragment thereof provided herein, and does not hybridize under such hybridization conditions with genomic DNA from an otherwise isogenic plant that does not comprise the segment, wherein the probe is homologous or complementary to SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, OR SEQ ID NO:126, or a sequence that encodes a pesticidal protein comprising an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83. The method may further comprise (a) subjecting the sample and probe to stringent hybridization conditions; and (b) detecting hybridization of the probe with DNA of the sample.

Also provided by the invention are methods of detecting the presence of a pesticidal protein or fragment thereof in a sample comprising protein, wherein said pesticidal protein comprises the amino acid sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, or SEQ ID NO:127; or said pesticidal protein comprises an amino acid sequence having: (i) at least 75% identity to SEQ ID NO:18, SEQ ID NO:20, SEQ ID NO:22, SEQ ID NO:24, SEQ ID NO:26, SEQ ID NO:28, SEQ ID NO:63, SEQ ID NO:65, SEQ ID NO:67, SEQ ID NO:69, SEQ ID NO:75, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, or SEQ ID NO:109; or (ii) at least 80% to SEQ ID NO:111 SEQ ID NO: 113, SEQ ID NO:115, SEQ ID NO:119, SEQ ID NO:125, or SEQ ID NO:127; or (iii) at least 85% identity to SEQ ID NO:121 or SEQ ID NO:123; or (iv) at least 90% identity to SEQ ID NO:2, SEQ ID NO:4, SEQ ID NO:6, SEQ ID NO:8, SEQ ID NO:10, SEQ ID NO:14, SEQ ID NO:34, SEQ ID NO:43, SEQ ID NO:46, SEQ ID NO:48, SEQ ID NO:50, SEQ ID NO:57, SEQ ID NO:71, SEQ ID NO:73, SEQ ID NO:77, SEQ ID NO:79, SEQ NO:81, or SEQ ID NO:117; or (v) at least 93% identity to SEQ ID NO:12, SEQ ID NO:16, SEQ ID NO:30, and SEQ ID NO:59; or (vi) at least 94% identity to SEQ ID NO:53 and SEQ ID NO:55; or (vii) at least 99% identity to SEQ ID NO:32, SEQ ID NO:61, or SEQ ID NO:83. In one embodiment, the method comprises: (a) contacting a sample with an immunoreactive antibody; and (b) detecting the presence of the protein. In some embodiments the step of detecting comprises an ELISA, or a Western blot.

BRIEF DESCRIPTION OF THE SEQUENCES

SEQ ID NO:1 is a nucleic acid sequence obtained from *Brevibacillus laterosporus* strain DSC005019 encoding a TIC7040 pesticidal protein sequence.

SEQ ID NO:2 is the amino acid sequence of the TIC7040 protein.

SEQ ID NO:3 is a nucleic acid sequence obtained from *Brevibacillus laterosporus* strain DSC005019 encoding a TIC7040HT pesticidal protein sequence.

SEQ ID NO:4 is the amino acid sequence of the TIC7040HT protein.

SEQ ID NO:5 is a nucleic acid sequence encoding a TIC7040_4 pesticidal protein sequence which comprises a C-terminal truncation relative to the TIC7040HT protein.

SEQ ID NO:6 is the amino acid sequence of the TIC7040_4 protein, consisting of amino acids 1 through 671 of TIC7040HT.

SEQ ID NO:7 is a nucleic acid sequence encoding a TIC7040_5 pesticidal protein sequence which comprises an N-terminal and C-terminal truncation relative to the TIC7040HT protein.

SEQ ID NO:8 is the amino acid sequence of the TIC7040_5 protein, comprising amino acids 13 through 611 of TIC7040HT.

SEQ ID NO:9 is a nucleic acid sequence encoding a TIC7040_6 pesticidal protein sequence which comprises an N-terminal and C-terminal truncation relative to the TIC7040HT protein.

SEQ ID NO:10 is the amino acid sequence of the TIC7040_6 protein, comprising amino acids 13 through 671 of TIC7040HT.

SEQ ID NO:11 is a nucleic acid sequence obtained from *Brevibacillus laterosporus* strain DSC005973 encoding a TIC7042 pesticidal protein sequence.

SEQ ID NO:12 is the amino acid sequence of the TIC7042 protein.

SEQ ID NO:13 is a nucleic acid sequence obtained from *Brevibacillus laterosporus* strain DSC006713 encoding a TIC7381 pesticidal protein sequence.

SEQ ID NO:14 is the amino acid sequence of the TIC7381 protein.

SEQ ID NO:15 is a nucleic acid sequence obtained from *Brevibacillus laterosporus* strain DSC007657 encoding a TIC7382 pesticidal protein sequence.

SEQ ID NO:16 is the amino acid sequence of the TIC7382 protein.

SEQ ID NO:17 is a nucleic acid sequence obtained from *Brevibacillus laterosporus* strain DSC008106 encoding a TIC7383 pesticidal protein sequence.

SEQ ID NO:18 is the amino acid sequence of the TIC7383 protein.

SEQ ID NO:19 is a nucleic acid sequence encoding a TIC7383_2 protein which comprises an N-terminal truncation relative to the TIC7383 protein.

SEQ ID NO:20 is the amino acid sequence of the TIC7383_2 protein, comprising amino acids 15 through 1256 of TIC7383.

SEQ ID NO:21 is a nucleic acid sequence encoding a TIC7383_3 protein which comprises a C-terminal truncation relative to the TIC7383 protein.

SEQ ID NO:22 is the amino acid sequence of the TIC7383_3 protein and consists of amino acids 1 through 659 of TIC7383.

SEQ ID NO:23 is a nucleic acid sequence encoding a TIC7383_4 protein which comprises a C-terminal truncation relative to the TIC7383 protein.

SEQ ID NO:24 is the amino acid sequence of the TIC7383_4 protein and consists of amino acids 1 through 679 of TIC7383.

SEQ ID NO:25 is a nucleic acid sequence encoding a TIC7383_5 protein which comprises an N-terminal and C-terminal truncation relative to the TIC7383 protein.

SEQ ID NO:26 is the amino acid sequence of the TIC7383_5 protein and comprises amino acids 15 through 659 of TIC7383.

SEQ ID NO:27 is a nucleic acid sequence encoding a TIC7383_6 protein which comprises an N-terminal and C-terminal truncation relative to the TIC7383 protein.

SEQ ID NO:28 is the amino acid sequence of the TIC7383_6 protein, comprising amino acids 15 through 679 of TIC7383.

SEQ ID NO:29 is a nucleic acid sequence obtained from *Brevibacillus laterosporus* strain DSC007651 encoding a TIC7386 pesticidal protein sequence.

SEQ ID NO:30 is the amino acid sequence of the TIC7386 protein.

SEQ ID NO:31 is a nucleic acid sequence obtained from *Brevibacillus laterosporus* strain DSC007962 encoding a TIC7388 pesticidal protein sequence.

SEQ ID NO:32 is the amino acid sequence of the TIC7388 protein.

SEQ ID NO:33 is a nucleic acid sequence obtained from *Brevibacillus laterosporus* strain DSC006878 encoding a TIC7389 pesticidal protein sequence.

SEQ ID NO:34 is the amino acid sequence of the TIC7389 protein.

SEQ ID NO:35 is a synthetic coding sequence, CR-BRE1a.TIC7040.nno_Mc:1, encoding a TIC7040 pesticidal protein used for expression in plant cells.

SEQ ID NO:36 is a synthetic coding sequence, CR-BRE1a.TIC7040_10.nno_Mc:1, encoding a TIC7040HT pesticidal protein used for expression in plant cells.

SEQ ID NO:37 is a synthetic coding sequence, CR-BRE1a.TIC7040_10.nno_Mc:3, encoding a TIC7040HT pesticidal protein used for expression in plant cells.

SEQ ID NO:38 is a synthetic coding sequence, CR-BRE1a.TIC7040_10.nno_Mc:4, encoding a TIC7040HT pesticidal protein used for expression in plant cells.

SEQ ID NO:39 is a synthetic coding sequence, CR-BRE1a.TIC7040_10.nno_Mc:5, encoding a TIC7040HT pesticidal protein used for expression in plant cells.

SEQ ID NO:40 is a synthetic coding sequence, CR-BRE1a.TIC7040_10.nno_Mc:6, encoding a TIC7040HT pesticidal protein used for expression in plant cells.

SEQ ID NO:41 is a synthetic coding sequence, CR-BRE1a.TIC7040_10.nno_Mc:7, encoding a TIC7040HT pesticidal protein used for expression in plant cells.

SEQ ID NO:42 is a synthetic coding sequence, CR-BRE1a.TIC7040_1.nno_Mc:1, encoding a protein having an N-terminal and C-terminal truncation relative to the TIC7040HT protein used for expression in plant cells.

SEQ ID NO:43 is the amino acid sequence of the CR-BRE1a.TIC7040_1.nno_Mc:1 protein, comprising amino acids 15 through 651 of TIC7040HT.

SEQ ID NO: 44 is a synthetic coding sequence, CR-BRE1a.TIC7040_2.nno_Mc:1, encoding a TIC7040_6 (SEQ ID NO:10) pesticidal protein sequence which comprises an N-terminal and C-terminal truncation relative to the TIC7040HT protein used for expression in plant cells.

SEQ ID NO:45 is a synthetic coding sequence, CR-BRE1a.TIC7040_11.nno_Mc:1, encoding a protein having an N-terminal and C-terminal truncation relative to the TIC7040HT protein used for expression in plant cells.

SEQ ID NO:46 is the amino acid sequence of the CR-BRE1a.TIC7040_11.nno_Mc:1 protein, comprising amino acids 14 through 671 of TIC7040HT.

SEQ ID NO:47 is a synthetic coding sequence, CR-BRE1a.TIC7040_12.nno_Mc:2, encoding a protein having a C-terminal truncation relative to the TIC7040HT protein used for expression in plant cells.

SEQ ID NO:48 is the amino acid sequence of the CR-BRE1a.TIC7040_12.nno_Mc:2 protein, consisting of amino acids 1 through 660 of TIC7040HT.

SEQ ID NO:49 is a synthetic coding sequence, CR-BRE1a.TIC7040_13.nno_Mc:1, which encodes a protein having a C-terminal truncation relative to the TIC7040HT protein used for expression in plant cells.

SEQ ID NO:50 is the amino acid sequence of the CR-BRE1a.TIC7040_13.nno_Mc:1 protein, consisting of amino acids 1 through 627 of TIC7040HT.

SEQ ID NO:51 is a synthetic coding sequence, CR-BRE1a.TIC7042.nno_Mc:1, which encodes a TIC7042 protein (SEQ ID NO:12) used for expression in plant cells.

SEQ ID NO:52 is a synthetic coding sequence, CR-BRE1a.TIC7042_1.nno_Mc:1, which encodes a protein having an N-terminal and C-terminal truncation relative to the TIC7042 protein used for expression in plant cells.

SEQ ID NO:53 is the amino acid sequence of the CR-BRE1a.TIC7042_1.nno_Mc:1 protein, comprising amino acids 11 through 646 of TIC7042.

SEQ ID NO:54 is a synthetic coding sequence, CR-BRE1a.TIC7042_2.nno_Mc:1, which encodes a protein having an N-terminal and C-terminal truncation relative to the TIC7042 protein used for expression in plant cells.

SEQ ID NO:55 is the amino acid sequence of the CR-BRE1a.TIC7042_2.nno_Mc:1 protein, comprising amino acids 11 through 665 of TIC7042.

SEQ ID NO:56 is a synthetic coding sequence, CR-BRE1a.TIC7381_1.nno_Mc:1, which encodes a TIC7381 protein wherein an additional alanine codon is inserted immediately following the initiating methionine codon used for expression in plant cells.

SEQ ID NO:57 is the amino acid sequence of CR-BRE1a.TIC7381_1.nno_Mc:1, wherein an additional alanine amino acid is inserted immediately following the initiating methionine relative to the TIC7381 protein sequence.

SEQ ID NO:58 is a synthetic coding sequence used for expression in plant cells, CR-BRE1a.TIC7382_1.nno_Mc:1, which encodes a TIC7382 protein wherein an additional alanine codon is inserted immediately following the initiating methionine codon.

SEQ ID NO:59 is the amino acid sequence of CR-BRE1a.TIC7382_1.nno_Mc:1, wherein an additional alanine amino acid is inserted immediately following the initiating methionine relative to the TIC7381 protein sequence.

SEQ ID NO:60 is a synthetic coding sequence used for expression in plant cells, CR-BRE1a.TIC7382_2.nno_Mc:1, which encodes a CR-BRE1a.TIC7382_2.nno_Mc:1 protein comprising a C-terminal truncation relative to the TIC7382 protein and wherein an additional alanine codon is inserted immediately following the initiating methionine codon.

SEQ ID NO:61 is the amino acid sequence of CR-BRE1a.TIC7382_2.nno_Mc:1 comprising a C-terminal deletion and wherein an additional alanine amino acid is inserted immediately following the initiating methionine relative to the TIC7382 protein sequence, and comprises amino acids 1 through 659 of TIC7382.

SEQ ID NO:62 is a synthetic coding sequence, CR-BRE1a.TIC7383_1.nno_Mc:1, which encodes a TIC7383 protein wherein an additional alanine codon is inserted immediately following the initiating methionine codon used for expression in plant cells.

SEQ ID NO:63 is the amino acid sequence of CR-BRE1a.TIC7383_1.nno_Mc:1, wherein an additional alanine amino acid is inserted immediately following the initiating methionine relative to the TIC7383 protein sequence.

SEQ ID NO:64 is a synthetic coding sequence, CR-BRE1a.TIC7383_7.nno_Mc:1, which encodes a CR-BRE1a.TIC7383_7.nno_Mc:1 protein comprising an N-terminal and C-terminal truncation relative to the TIC7383 protein and wherein an additional alanine codon is inserted immediately following the initiating methionine codon and which is used for expression in plant cells.

SEQ ID NO:65 is the amino acid sequence of CR-BRE1a.TIC7383_7.nno_Mc:1 comprising an N-terminal and C-terminal deletion and wherein an additional alanine amino acid is inserted immediately following the initiating methionine relative to the TIC7383 protein sequence, and comprises amino acids 54 through 668 of TIC7383.

SEQ ID NO:66 is a synthetic coding sequence, CR-BRE1a.TIC7383_8.nno_Mc:1, which encodes a CR-BRE1a.TIC7383_8.nno_Mc:1 protein comprising a C-terminal truncation relative to the TIC7383 protein, wherein an additional alanine codon is inserted immediately following the initiating methionine codon and which is used for expression in plant cells.

SEQ ID NO:67 is the amino acid sequence of CR-BRE1a.TIC7383_8.nno_Mc:1 comprising a C-terminal deletion, and wherein an additional alanine amino acid is inserted immediately following the initiating methionine relative to the TIC7383 protein sequence, and comprises amino acids 1 through 661 of TIC7383.

SEQ ID NO:68 is a synthetic coding sequence, CR-BRE1a.TIC7383_9.nno_Mc:1, which encodes a CR-BRE1a.TIC7383_9.nno_Mc:1 protein comprising a C-terminal truncation relative to the TIC7383 protein, wherein an additional alanine codon is inserted immediately following the initiating methionine codon, and which is used for expression in plant cells.

SEQ ID NO:69 is the amino acid sequence of CR-BRE1a.TIC7383_9.nno_Mc:1, comprising a C-terminal deletion wherein an additional alanine amino acid is inserted immediately following the initiating methionine relative to the TIC7383 protein sequence, and comprises amino acids 1 through 668 of TIC7383.

SEQ ID NO:70 is a coding sequence encoding the tryptic core (TIC7040HT_Tryp) of the TIC7040HT protein as determined by mass spectrometry.

SEQ ID NO:71 is the amino acid sequence of the tryptic core (TIC7040HT_Tryp) of the TIC7040HT protein as determined by mass spectrometry, and comprises amino acids 43 through 624 of TIC7040HT.

SEQ ID NO:72 is a coding sequence encoding the chymotryptic core (TIC7040HT_Chymo) of the TIC7040HT protein as determined by mass spectrometry.

SEQ ID NO:73 is the amino acid sequence of the chymotryptic core (TIC7040HT_Chymo) of the TIC7040HT protein as determined by mass spectrometry, and comprises amino acids 45 through 641 of TIC7040HT.

SEQ ID NO:74 is a coding sequence encoding the tryptic core (TIC7383_Tryp) of the TIC7383 protein as determined by mass spectrometry.

SEQ ID NO:75 is the amino acid sequence of the tryptic core (TIC7383_Tryp) of the TIC7383 protein as determined by mass spectrometry, and comprises amino acids 55 through 668 of TIC7383.

SEQ ID NO:76 is a synthetic coding sequence, CR-BRE1a.TIC7040_14.nno_Mc:1, encoding a CR-BRE1a.TIC7040_14.nno_Mc:1 protein having an N-terminal and C-terminal truncation relative to the TIC7040HT protein, wherein an additional alanine codon is inserted immediately following the initiating methionine codon, and which is used for expression in plant cells.

SEQ ID NO:77 is the amino acid sequence of the CR-BRE1a.TIC7040_14.nno_Mc:1 protein, wherein an additional alanine amino acid is inserted immediately following the initiating methionine, and comprises amino acids 52 through 660 of TIC7040HT.

SEQ ID NO:78 is a synthetic coding sequence, CR-BRE1a.TIC7381_2.nno_Mc:1, encoding a CR-BRE1a.TIC7381_2.nno_Mc:1 protein having a C-terminal truncation relative to the TIC7381 protein, wherein an additional alanine codon is inserted immediately following the initiating methionine codon, and which is used for expression in plant cells.

SEQ ID NO:79 is the amino acid sequence of the CR-BRE1a.TIC7381_2.nno_Mc:1 protein, wherein an additional alanine amino acid is inserted immediately following the initiating methionine, and comprises amino acids 1 through 658 of TIC7381.

SEQ ID NO:80 is a synthetic coding sequence, CR-BRE1a.TIC7381_3.nno_Mc:1, encoding a CR-BRE1a.TIC7381_3.nno_Mc:1 protein having an N-terminal and C-terminal truncation relative to the TIC7381 protein, wherein an additional alanine codon is inserted immediately following the initiating methionine codon, and which is used for expression in plant cells.

SEQ ID NO:81 is the amino acid sequence of the CR-BRE1a.TIC7381_3.nno_Mc:1 protein, wherein an additional alanine amino acid is inserted immediately following the initiating methionine, and comprises amino acids 50 through 658 of TICTIC7381.

SEQ ID NO:82 is a synthetic coding sequence, CR-BRE1a.TIC7382_3.nno_Mc:1, encoding a CR-BRE1a.TIC7382_3.nno_Mc:1 protein having an N-terminal and C-terminal truncation relative to the TIC7382 protein, wherein an additional alanine codon is inserted immediately following the initiating methionine codon, and which is used for expression in plant cells.

SEQ ID NO:83 is the amino acid sequence of the CR-BRE1a.TIC7382_3.nno_Mc:1 protein, wherein an additional alanine amino acid is inserted immediately following the initiating methionine, and comprises amino acids 52 through 659 of TIC7382.

SEQ ID NO:84 is a synthetic coding sequence, CR-BRE1a.TIC7383_19.nno_Mc:1, encoding a CR-BRE1a.TIC7383_19.nno_Mc:1 protein having an N-terminal and C-terminal truncation relative to the TIC7383 protein, and which is used for expression in plant cells.

SEQ ID NO:85 is the amino acid sequence of the CR-BRE1a.TIC7383_19.nno_Mc:1 protein, and comprises amino acids 15 through 668 of TIC7383.

SEQ ID NO:86 is a synthetic coding sequence, CR-BRE1a.TIC7383_20.nno_Mc:1, encoding a CR-BRE1a.TIC7383_20.nno_Mc:1 protein having an N-terminal and C-terminal truncation relative to the TIC7383 protein, and which is used for expression in plant cells.

SEQ ID NO:87 is the amino acid sequence of the CR-BRE1a.TIC7383_20.nno_Mc:1 protein, and comprises amino acids 15 through 661 of TIC7383.

SEQ ID NO:88 is a synthetic coding sequence, CR-BRE1a.TIC7383_21.nno_Mc:1, encoding a CR-BRE1a.TIC7383_21.nno_Mc:1 protein having an N-terminal and C-terminal truncation relative to the TIC7383 protein, wherein an additional alanine codon is inserted immediately following the initiating methionine codon, and which is used for expression in plant cells.

SEQ ID NO:89 is the amino acid sequence of the CR-BRE1a.TIC7383_21.nno_Mc:1 protein, wherein an additional alanine amino acid is inserted immediately following the initiating methionine, and comprises amino acids 54 through 661 of TIC7383.

SEQ ID NO:90 is a synthetic coding sequence, CR-BRE1a.TIC7383_22.nno_Mc:1, encoding a CR-BRE1a.TIC7383_22.nno_Mc:1 protein having an N-terminal and C-terminal truncation relative to the TIC7383 protein, and which is used for expression in plant cells.

SEQ ID NO:91 is the amino acid sequence of the CR-BRE1a.TIC7383_22.nno_Mc:1 protein, and comprises amino acids 54 through 668 of TIC7383.

SEQ ID NO:92 is a synthetic coding sequence, CR-BRE1a.TIC7383_23.nno_Mc:1, encoding a CR-BRE1a.TIC7383_23.nno_Mc:1 protein having an N-terminal and C-terminal truncation relative to the TIC7383 protein, and which is used for expression in plant cells.

SEQ ID NO:93 is the amino acid sequence of the CR-BRE1a.TIC7383_23.nno_Mc:1 protein, and comprises amino acids 54 through 661 of TIC7383.

SEQ ID NO:94 is a synthetic coding sequence, CR-BRE1a.TIC7383_24.nno_Mc:2, encoding a CR-BRE1a.TIC7383_24.nno_Mc:2 protein having an N-terminal and C-terminal truncation relative to the TIC7383 protein, and which is used for expression in plant cells.

SEQ ID NO:95 is the amino acid sequence of the CR-BRE1a.TIC7383_24.nno_Mc:2 protein, and comprises amino acids 73 through 661 of TIC7383.

SEQ ID NO:96 is a synthetic coding sequence, CR-BRE1a.TIC7383_25.nno_Mc:3, encoding a CR-BRE1a.TIC7383_25.nno_Mc:3 protein having an N-terminal and C-terminal truncation relative to the TIC7383 protein, and which is used for expression in plant cells.

SEQ ID NO:97 is the amino acid sequence of the CR-BRE1a.TIC7383_25.nno_Mc:3 protein, and comprises amino acids 94 through 661 of TIC7383.

SEQ ID NO:98 is a synthetic coding sequence, CR-BRE1a.TIC7383_26.nno_Mc:1, encoding a CR-BRE1a.TIC7383_26.nno_Mc:1 protein having an N-terminal and C-terminal truncation relative to the TIC7383 protein, and which is used for expression in plant cells.

SEQ ID NO:99 is the amino acid sequence of the CR-BRE1a.TIC7383_26.nno_Mc:1 protein, and comprises amino acids 114 through 661 of TIC7383.

SEQ ID NO:100 is a synthetic coding sequence, CR-BRE1a.TIC7383_27.nno_Mc:1, encoding a CR-BRE1a.TIC7383_27.nno_Mc:1 protein having an N-terminal and C-terminal truncation relative to the TIC7383 protein, wherein an additional alanine codon is inserted immediately following the initiating methionine codon, and which is used for expression in plant cells.

SEQ ID NO:101 is the amino acid sequence of the CR-BRE1a.TIC7383_27.nno_Mc:1 protein, wherein an additional alanine amino acid is inserted immediately following the initiating methionine, and comprises amino acids 54 through 658 of TIC7383.

SEQ ID NO:102 is a synthetic coding sequence, CR-BRE1a.TIC7383_28.nno_Mc:1, encoding a CR-BRE1a.TIC7383_28.nno_Mc:1 protein having an N-terminal and C-terminal truncation relative to the TIC7383 protein, and which is used for expression in plant cells.

SEQ ID NO:103 is the amino acid sequence of the CR-BRE1a.TIC7383_28.nno_Mc:1 protein, and comprises amino acids 15 through 658 of TIC7383.

SEQ ID NO:104 is a synthetic coding sequence, CR-BRE1a.TIC7383_29.nno_Mc:1, encoding a CR-BRE1a.TIC7383_29.nno_Mc:1 protein having a C-terminal truncation relative to the TIC7383 protein, wherein an additional alanine codon is inserted immediately following the initiating methionine codon, and which is used for expression in plant cells.

SEQ ID NO:105 is the amino acid sequence of the CR-BRE1a.TIC7383_29.nno_Mc:1 protein, wherein an additional alanine amino acid is inserted immediately following the initiating methionine, and comprises amino acids 1 through 963 of TIC7383.

SEQ ID NO:106 is a synthetic coding sequence, CR-BRE1a.TIC7383_30.nno_Mc:1, encoding a CR-BRE1a.TIC7383_30.nno_Mc:1 protein, wherein an additional alanine codon is inserted immediately following the initiating methionine codon, and comprising mutations to the codons corresponding amino acid positions 964, 966, and 968 relative to TIC7383, and which is used for expression in plant cells.

SEQ ID NO:107 is the amino acid sequence of the CR-BRE1a.TIC7383_30.nno_Mc:1 protein, wherein an additional alanine amino acid is inserted immediately following the initiating methionine, and comprises the mutations, K964A; R966A; K968A, relative to TIC7383.

SEQ ID NO:108 is a synthetic coding sequence, CR-BRE1a.TIC7383_31.nno_Mc:1, encoding a CR-BRE1a.TIC7383_31.nno_Mc:1 protein having a C-terminal truncation relative to the TIC7383 protein, wherein an additional alanine codon is inserted immediately following the initiating methionine codon, and comprising mutations to the codons corresponding amino acid positions 964, 966, and 968 relative to TIC7383, and which is used for expression in plant cells.

SEQ ID NO:109 is the amino acid sequence of the CR-BRE1a.TIC7383_31.nno_Mc:1 protein, wherein an additional alanine amino acid is inserted immediately following the initiating methionine, and comprising amino acids 1 through 1065, and also comprises the mutations, K964A; R966A; K968A, relative to TIC7383.

SEQ ID NO:110 is a synthetic coding sequence, CR-BRE1a.TIC7383_32.nno_Mc:1, encoding a CR-BRE1a.TIC7383_32.nno_Mc:1 protein, wherein an additional alanine codon is inserted immediately following the initiating methionine codon, and comprising a deletion of the codons corresponding amino acid positions 964 through 969 relative to TIC7383, and which is used for expression in plant cells.

SEQ ID NO:111 is the amino acid sequence of the CR-BRE1a.TIC7383_32.nno_Mc:1 protein, wherein an additional alanine amino acid is inserted immediately following the initiating methionine, and comprising a deletion of amino acids 964 through 969 relative to TIC7383.

SEQ ID NO:112 is a synthetic coding sequence, GOI-TIC10743.nno_Mc:1, encoding a GOI-TIC10743.nno_Mc:1 chimeric protein comprised of domains one and two of TIC7383 and domain three of TIC7042.

SEQ ID NO:113 is the amino acid sequence of the GOI-TIC10743.nno_Mc:1 chimeric protein.

SEQ ID NO:114 is a synthetic coding sequence, GOI-TIC10744.nno_Mc:1, encoding a GOI-TIC10744.nno_Mc:1 chimeric protein comprised of domains one and two of TIC7383 and domain three of TIC7381.

SEQ ID NO:115 is the amino acid sequence of the GOI-TIC10744.nno_Mc:1 chimeric protein.

SEQ ID NO:116 is a synthetic coding sequence, GOI-TIC10745.nno_Mc:1, encoding a GOI-TIC10745.nno_Mc:1 chimeric protein comprised of domains one and two of TIC7383 and domain three of TIC7382.

SEQ ID NO:117 is the amino acid sequence of the GOI-TIC10745.nno_Mc:1 chimeric protein.

SEQ ID NO:118 is a synthetic coding sequence, GOI-TIC10746.nno_Mc:1, encoding a GOI-TIC10746.nno_Mc:1 chimeric protein comprised of domains one and two of TIC7382 and domain three of TIC7383.

SEQ ID NO:119 is the amino acid sequence of the GOI-TIC10746.nno_Mc:1 chimeric protein.

SEQ ID NO:120 is a synthetic coding sequence, GOI-TIC10747.nno_Mc:1, encoding a GOI-TIC10747.nno_Mc:1 chimeric protein comprised of domains one and two of TIC7381 and domain three of TIC7383.

SEQ ID NO:121 is the amino acid sequence of the GOI-TIC10747.nno_Mc:1 chimeric protein.

SEQ ID NO:122 is a synthetic coding sequence, GOI-TIC10748.nno_Mc:1, encoding a GOI-TIC10748.nno_Mc:1 chimeric protein comprised of domains one and two of TIC7042 and domain three of TIC7383.

SEQ ID NO:123 is the amino acid sequence of the GOI-TIC10748.nno_Mc:1 chimeric protein.

SEQ ID NO:124 is a synthetic coding sequence, TIC10746NTermExt1, encoding a TIC10746NTermExt1 chimeric protein comprised of domains one and two of TIC7382 and domain three of TIC7383 which also includes the N-terminal extension peptide derived from TIC7382. The N-terminal extension of TIC7382 comprises amino acids 1-51 of the TIC7382 toxin protein and is encoded by the first 153 nucleotides of the TIC7382 coding sequence.

SEQ ID NO:125 is the amino acid sequence of the TIC10746NTermExt1 chimeric protein.

SEQ ID NO:126 is a synthetic coding sequence, TIC10746NTermExt2, encoding a TIC10746NTermExt2 chimeric protein comprised of domains one and two of TIC7382 and domain three of TIC7383 which also includes the N-terminal extension peptide derived from TIC7383. The N-terminal extension of TIC7383 comprises amino acids 1-53 of the TIC7383 toxin protein and is encoded by the first 159 nucleotides of the TIC7383 coding sequence.

SEQ ID NO:127 is the amino acid sequence of the TIC10746NTermExt2 chimeric protein.

DETAILED DESCRIPTION OF THE INVENTION

The problem in the art of agricultural pest control can be characterized as a need for new toxin proteins that are efficacious against target pests, exhibit broad spectrum toxicity against target pest species, are capable of being expressed in plants without causing undesirable agronomic issues, and provide an alternative mode of action compared to current toxins that are used commercially in plants.

Novel insecticidal protein classes, exemplified by TIC7040, TIC7040HT, TIC7042, TIC7381, TIC7382, TIC7383, TIC7386, TIC7388, and TIC7389 and related family members that provide resistance against Coleopteran and Lepidopteran insect pests, and more particularly against corn rootworm pest species, are disclosed. Also disclosed are synthetic coding sequences designed for expression in a plant cell that encode TIC7040, TIC7040HT, TIC7042, TIC7381, TIC7382, and TIC7383 related family members, along with N-terminal and C-terminal truncation variants and chimeras of proteins in TIC7040 toxin class. Further disclosed are recombinant nucleic acid molecules comprising a promoter in operable linkage to a coding sequence encoding a TIC7040, TIC7040HT, TIC7042, TIC7381, TIC7382, TIC7383, TIC7386, TIC7388, or TIC7389 toxin protein, or related family members, or fragments thereof.

Reference in this application to TIC7040, "TIC7040 protein", "TIC7040 protein toxin", "TIC7040 toxin protein", "TIC7040 pesticidal protein", "TIC7040-related toxins", or "TIC7040-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7040 (SEQ ID NO:2) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7040 results in amino acid sequence identity of any fraction percentage from about 90 to about 100 percent.

Reference in this application to TIC7040HT, "TIC7040HT protein", "TIC7040HT protein toxin", "TIC7040HT toxin protein", "TIC7040HT pesticidal protein", "TIC7040HT-related toxins", or "TIC7040HT-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7040HT (SEQ ID NO:4) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7040HT results in amino acid sequence identity of any fraction percentage from about 90 to about 100 percent.

Reference in this application to TIC7042, "TIC7042 protein", "TIC7042 protein toxin", "TIC7042 toxin protein", "TIC7042 pesticidal protein", "TIC7042-related toxins", or "TIC7042-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7042 (SEQ ID NO:12) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7042 results in amino acid sequence identity of any fraction percentage from about 93 to about 100 percent.

Reference in this application to TIC7381, "TIC7381 protein", "TIC7381 protein toxin", "TIC7381 toxin protein", "TIC7381 pesticidal protein", "TIC7381-related toxins", or "TIC7381-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7381 (SEQ ID NO:14) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7381 results in amino acid sequence identity of any fraction percentage from about 90 to about 100 percent.

Reference in this application to TIC7382, "TIC7382 protein", "TIC7382 protein toxin", "TIC7382 toxin protein", "TIC7382 pesticidal protein", "TIC7382-related toxins", or "TIC7382-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7382 (SEQ ID NO:16) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7382 results in amino acid sequence identity of any fraction percentage from about 93 to about 100 percent.

Reference in this application to TIC7383, "TIC7383 protein", "TIC7383 protein toxin", "TIC7383 toxin protein", "TIC7383 pesticidal protein", "TIC7383-related toxins", or "TIC7383-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7383 (SEQ ID NO:18) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7383 results in amino acid sequence identity of any fraction percentage from about 75 to about 100 percent.

Reference in this application to TIC7386, "TIC7386 protein", "TIC7386 protein toxin", "TIC7386 toxin protein", "TIC7386 pesticidal protein", "TIC7386-related toxins", or "TIC7386-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7386 (SEQ ID NO:30) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7386 results in amino acid sequence identity of any fraction percentage from about 75 to about 100 percent.

Reference in this application to TIC7388, "TIC7388 protein", "TIC7388 protein toxin", "TIC7388 toxin protein", "TIC7388 pesticidal protein", "TIC7388-related toxins", or "TIC7388-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7388 (SEQ ID NO:32) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7388 results in amino acid sequence identity of any fraction percentage from about 99 to about 100 percent.

Reference in this application to TIC7389, "TIC7389 protein", "TIC7389 protein toxin", "TIC7389 toxin protein", "TIC7389 pesticidal protein", "TIC7389-related toxins", or "TIC7389-related toxin protein", and the like, refer to any novel pesticidal protein or insect inhibitory protein, that comprises, that consists of, that is substantially homologous to, that is similar to, or that is derived from any pesticidal protein or insect inhibitory protein sequence of TIC7389 (SEQ ID NO:34) and pesticidal or insect inhibitory segments thereof, or combinations thereof, that confer activity against Coleopteran pests or Lepidopteran pests, including any protein exhibiting pesticidal or insect inhibitory activity if alignment of such protein with TIC7389 results in amino acid sequence identity of any fraction percentage from about 90 to about 100 percent.

The term "segment" or "fragment" is used in this application to describe consecutive amino acid or nucleic acid sequences that are shorter than the complete amino acid or nucleic acid sequence describing a TIC7040, TIC7040HT, TIC7042, TIC7381, TIC7382, TIC7383, TIC7386, TIC7388, or TIC7389 protein or related family member insecticidal protein. In specific embodiments, fragments of a TIC7040, TIC7040HT, TIC7042, TIC7381, TIC7382, TIC7383, TIC7386, TIC7388, or TIC7389 protein are provided comprising at least about 50, at least about 75, at least about 95, at least about 100, at least about 125, at least about 150, at least about 175, at least about 200, at least about 225, at least about 250, at least about 275, at least about 300, at least about 500, at least about 600, at least about 700, at least about 750, at least about 800, at least about 850, at least about 900, at least about 950, at least about 1000, at least about 1050, at least about 1100, at least about 1150, at least about 1200, at least about 1250, at least about 1300, or at least about 1350 contiguous amino acids, or longer, of a protein having insecticidal activity as disclosed herein. In certain embodiments, the invention provides fragments of a protein provided herein, having the activity of the full length sequence. Methods for producing such fragments from a starting molecule are well known in the art.

A segment or fragment exhibiting insect inhibitory activity is also disclosed in this application if alignment of such segment or fragment, with the corresponding section of the TIC7040, TIC7040HT, TIC7042, TIC7381, TIC7382, TIC7383, TIC7386, TIC7388, or TIC7389 protein set forth in SEQ ID NOs:2, 4, 12, 14, 16, 18, 20, 30, 32, and 34, results in amino acid sequence identity of any fraction percentage from about 75 to about 100 percent between the segment or fragment and the corresponding section of the TIC7383 and TIC7386 proteins; or respectively results in amino acid sequence identity of any fraction percentage from about 90 to about 100 percent between the segment or fragment and the corresponding section of the TIC7040, TIC7040HT, TIC7381, and TIC7389 proteins; or respectively results in amino acid sequence identity of any fraction percentage from about 93 to about 100 percent between the segment or fragment and the corresponding section of the TIC7042 and TIC7382 proteins; or respectively results in amino acid sequence identity of any fraction percentage from about 99 to about 100 percent between the segment or fragment and the corresponding section of the TIC7388 protein.

Reference in this application to the terms "active" or "activity", "pesticidal activity" or "pesticidal" or "insecticidal activity", "insect inhibitory" or "insecticidal" refer to efficacy of a toxic agent, such as a protein toxin, in inhibiting (inhibiting growth, feeding, fecundity, or viability), suppressing (suppressing growth, feeding, fecundity, or viability), controlling (controlling the pest infestation, controlling the pest feeding activities on a particular crop containing an effective amount of the TIC7040, TIC7040HT, TIC7042, TIC7381, TIC7382, TIC7383, TIC7386, TIC7388, or TIC7389 protein or related family member insecticidal protein) or killing (causing the morbidity, mortality, or reduced fecundity of) a pest. These terms are intended to include the result of providing a pesticidally effective amount of a toxic protein to a pest where the exposure of the pest to the toxic protein results in morbidity, mortality, reduced fecundity, or stunting. These terms also include repulsion of the pest from the plant, a tissue of the plant, a plant part, seed, plant cells, or from the particular geographic location where the plant may be growing, as a result of providing a pesticidally effective amount of the toxic protein in or on the plant. In general, pesticidal activity refers to the ability of a toxic protein to be effective in inhibiting the growth, development, viability, feeding behavior, mating behavior, fecundity, or any measurable decrease in the adverse effects caused by an insect feeding on this protein, protein fragment, protein segment or polynucleotide of a particular target pest, including but not limited to insects of the order Lepidoptera, Coleoptera or Hemiptera. The toxic protein can be produced by the plant or can be applied to the plant or to the environment within the location where the plant is located. The terms "bioactivity", "effective", "efficacious" or variations thereof are also terms interchangeably utilized in this application to describe the effects of proteins of the present invention on target insect pests.

A pesticidally effective amount of a toxic agent, when provided in the diet of a target pest, exhibits pesticidal activity when the toxic agent contacts the pest. A toxic agent can be a pesticidal protein or one or more chemical agents known in the art. Pesticidal or insecticidal chemical agents and pesticidal or insecticidal protein agents can be used alone or in combinations with each other. Chemical agents include, but are not limited to, dsRNA molecules targeting specific genes for suppression in a target pest, organochlorides, organophosphates, carbamates, pyrethroids, neonicotinoids, and ryanoids. Pesticidal or insecticidal protein agents include the protein toxins set forth in this application, as well as other proteinaceous toxic agents including those that target Lepidopteran and Coleopteran pest species, as well as protein toxins that are used to control other plant pests such as Cry proteins available in the art for use in controlling Homopteran or Hemipteran species.

It is intended that reference to a pest, particularly a pest of a crop plant, means insect pests of crop plants, particularly those that are controlled by a TIC7040, TIC7040HT, TIC7042, TIC7381, TIC7382, TIC7383, TIC7386, TIC7388, or TIC7389 protein or related family member insecticidal protein. Reference to a pest can also include Homopteran and Hemipteran insect pests of plants, as well as nematodes and fungi when toxic agents targeting these pests are co-localized or present together with a TIC7040, TIC7040HT, TIC7042, TIC7381, TIC7382, TIC7383, TIC7388, TIC7389 proteins or related family member insecticidal protein, or a protein that is about 75 to about 100 percent identical to TIC7383 and TIC7386; or a protein that is about 90 to about 100 percent identical to TIC7040, TIC7040HT, TIC7381, and TIC7389; or a protein that is about 93 to about 100 percent identical to TIC7042, TIC7386, and TIC7382; or a protein that is about 99 to about 100 percent identical to TIC7388.

The TIC7040, TIC7040HT, TIC7042, TIC7381, TIC7382, TIC7383, TIC7386, TIC7388, TIC7389 and related family member insecticidal proteins exhibit insecticidal activity towards insect pests from the Coleopteran and Lepidopteran insect species, including adults, pupae, larvae, and neonates.

The insects of the order Lepidoptera include, but are not limited to, armyworms, cutworms, loopers, and heliothines in the Family Noctuidae, e.g., fall armyworm (*Spodoptera frugiperda*), Beet armyworm (*Spodoptera exigua*), Black armyworm (*Spodoptera exempta*), Bertha armyworm (*Mamestra configurata*), Southern armyworm (*Spodoptera eridania*), Black cutworm (*Agrotis ipsilon*), Cabbage looper (*Trichoplusia ni*), Soybean looper (*Pseudoplusia includens*), Velvetbean caterpillar (*Anticarsia gemmatalis*), Green cloverworm (*Hypena scabra*), Tobacco budworm (*Heliothis virescens*), Granulate cutworm (*Agrotis subterranea*), Armyworm (*Pseudaletia unipuncta*), Western cutworm (*Agrotis orthogonia*); borers, casebearers, webworms, coneworms, cabbageworms and skeletonizers from the Family Pyralidae, e.g., European corn borer (*Ostrinia nubilalis*), Navel orangeworm (*Amyelois transitella*), Corn root webworm (*Crambus caliginosellus*), Sod webworm (*Herpetogramma licarsisalis*), Sunflower moth (*Homoeosoma electellum*), Lesser cornstalk borer (*Elasmopalpus lignosellus*); leafrollers, budworms, seed worms, and fruit worms in the Family Tortricidae, e.g., Codling moth (*Cydia pomonella*), Grape berry moth (*Endopiza viteana*), Oriental fruit moth (*Grapholita molesta*), Sunflower bud moth (*Suleima helianthana*); and many other economically important Lepidoptera, e.g., Diamondback moth (*Plutella xylostella*), Pink bollworm (*Pectinophora gossypiella*) and Gypsy moth (*Lymantria dispar*). Other insect pests of order Lepidoptera include, e.g., Cotton leaf worm (*Alabama argillacea*), Fruit tree leaf roller (*Archips argyrospila*), European leafroller (*Archips rosana*) and other *Archips* species, (*Chilo suppressalis*, Asiatic rice borer, or rice stem borer), Rice leaf roller (*Cnaphalocrocis medinalis*), Corn root webworm (*Crambus caliginosellus*), Bluegrass webworm (*Crambus teterrellus*), Southwestern corn borer (*Diatraea grandiosella*), Surgarcane borer (*Diatraea saccharalis*), Spiny bollworm (*Earias insulana*), Spotted bollworm (*Earias vittella*), Old World bollworm (*Helicoverpa armigera*), Corn earworm (*Helicoverpa zea*, also known as soybean podworm and cotton bollworm), Western bean cutworm (*Striacosta albicosta*), European grape vine moth (*Lobesia botrana*), Citrus leafminer (*Phyllocnistis citrella*), large white butterfly (*Pieris brassicae*), small white butterfly (*Pieris rapae*, also known as imported cabbageworm), Tobacco cutworm (*Spodoptera litura*, also known as cluster caterpillar), and Tomato leafminer (*Tuta absoluta*).

The insects of the order Coleoptera include, but are not limited to, *Agriotes* spp., *Anthonomus* spp., *Atomaria linearis*, *Chaetocnema tibialis*, *Cosmopolites* spp., *Curculio* spp., *Dermestes* spp., *Diabrotica* spp., *Epilachna* spp., *Eremnus* spp., *Leptinotarsa decemlineata*, *Lissorhoptrus* spp., *Melolontha* spp., *Orycaephilus* spp., *Otiorhynchus* spp., *Phlyctinus* spp., *Popillia* spp., *Psylliodes* spp., *Rhizopertha* spp., *Scarabeidae*, *Sitophilus* spp., *Sitotroga* spp., *Tenebrio* spp., *Tribolium* spp. and *Trogoderma* spp, particularly when the pest is Western Corn Rootworm (*Diabrotica virgifera*, WCR), Northern Corn Rootworm (*Diabrotica barberi*, NCR), Mexican Corn Rootworm (*Diabrotica virgifera zeae*, MCR), Brazilian Corn Rootworm (*Diabrotica balteata*, BZR), Southern Corn Rootworm (*Diabrotica undecimpunctata howardii*, SCR), Colorado potato beetle (*Leptinotarsa decemlineata*, CPB), a Brazilian Corn Rootworm complex (BCR, consisting of *Diabrotica viridula* and *Diabrotica speciosa*), Crucifer Flea Beetle (*Phyllotreta cruciferae*), Striped Flea Beetle (*Phyllotreta striolata*), and Western Black Flea Beetle (*Phyllotreta pusilla*).

The insects of the order Hemiptera include, but are not limited to, Stink Bugs of the family Pentatomidae: Green Stink Bugs from the genus *Chinavia* (*Chinavia hilaris*, *Chinavia marginata*, and *Chinavia pensylvanica*), Stink bugs of the genus *Chlorochroa* (*Chlorochroa granulose*, *Chlorochroa kanei*, *Chlorochroa ligata*, *Chlorochroa lineate*, *Chlorochroa opuntiae*, *Chlorochroa persimilis*, *Chlorochroa rossiana*, *Chlorochroa sayi*, *Chlorochroa uhleri*, *Chlorochroa belfragii*, *Chlorochroa faceta*, *Chlorochroa osborni*, *Chlorochroa saucia*, and *Chlorochroa senilis*), Southern Green Stink Bug (*Nezara viridula*), Stink Bugs from the genus *Edessa* (*Edessa meditabunda*, *Edessa bifida*, and *Edessa florida*), the Neotropical Brown Stink Bug (*Euschistus heros*), stink bugs from the genus *Euschistus* (*Euschistus acuminatus*, *Euschistus biformis*, *Euschistus conspersus*, *Euschistus crenator*, *Euschistus egglestoni*, *Euschistus ictericus*, *Euschistus inflatus*, *Euschistus latimarginatus*, *Euschistus obscures*, *Euschistus politus*, *Euschistus quadrator*, *Euschistus sevus*, *Euschistus strenuous*, *Euschistus tristigmus*, and *Euschistus variolarius*), Brown Marmorated Stink Bug (*Halyomorpha halys*), Red-Shouldered Stink Bug (*Thyanta accerra*), stink bugs of the genus *Thyanta* (*Thyanta calceata*, *Thyanta custator*, *Thyanta pallidovirens*, *Thyanta perditor*, *Thyanta maculate*, and *Thyanta pseudocasta*), the Green Belly Stink Bug (*Dichelops melacanthus*) and other stink bugs of the genus *Dichelops* (*Dichelops avilapiresi*, *Dichelops bicolor*, *Dichelops dimidatus*, *Dichelops furcatus*, *Dichelops furcifrons*, *Dichelops lobatus*, *Dichelops miriamae*, *Dichelops nigrum*, *Dichelops peruanus*, *Dichelops phoenix*, and *Dichelops saltensis*), the Red Banded Stink Bug (*Piezodorus guildinni*) as well as *Piezodorus lituratus*; and insects of the family of Plataspidae such as Kudzu Bug (*Megacopta cribraria*), Western tarnished plant bug (*Lygus hesperus*), and Tarnished plant bug (*Lygus lineolaris*).

Reference in this application to an "isolated DNA molecule", or an equivalent term or phrase, is intended to mean that the DNA molecule is one that is present alone or in combination with other compositions, but not within its natural environment. For example, nucleic acid elements such as a coding sequence, intron sequence, untranslated leader sequence, promoter sequence, transcriptional termination sequence, and the like, that are naturally found within the DNA of the genome of an organism are not considered to be "isolated" so long as the element is within the genome of the organism and at the location within the genome in which it is naturally found. However, each of these elements, and subparts of these elements, would be "isolated" within the scope of this disclosure so long as the element is not within the genome of the organism and at the location within the genome in which it is naturally found. Similarly, a nucleotide sequence encoding an insecticidal protein or any naturally occurring insecticidal variant of that protein would be an isolated nucleotide sequence so long as the nucleotide sequence was not within the DNA of the bacterium from which the sequence encoding the protein is naturally found. A synthetic nucleotide sequence encoding the amino acid sequence of the naturally occurring insecticidal protein would be considered to be isolated for the purposes of this disclosure. For the purposes of this disclosure, any transgenic nucleotide sequence, i.e., the nucleotide sequence of the DNA inserted into the genome of the cells of a plant or bacterium, or present in an extrachromosomal vector, would be considered to be an isolated nucleotide sequence whether it is present within the plasmid or similar structure used to transform the cells, within the genome of the plant or bacterium, or present in detectable amounts in tissues, progeny, biological samples or commodity products derived from the plant or bacterium.

As described further herein, an open reading frame (ORF) encoding TIC7040 (SEQ ID NO:1), was discovered in DNA obtained from *Brevibacillus laterosporus* strain DSC005019, which encodes the protein toxin presented as SEQ ID NO:2. Upon amplification using primers designed from the TIC7040 ORF, a slightly longer coding sequence was amplified using DNA obtained from *Brevibacillus laterosporus* strain DSC005019, herein referred to as TIC7040HT (SEQ ID NO:3), which encodes the protein presented as SEQ ID NO:4. Bioassay using microbial host cell-derived TIC7040HT protein demonstrated activity against the Coleopteran pests Western Corn Rootworm (*Diabrotica virgifera virgifera*, WCR), Cry3Bb-resistant Western Corn Rootworm (*Diabrotica virgifera virgifera*, WCRHP), Northern Corn Rootworm (*Diabrotica barberi*, NCR), Southern Corn Rootworm (*Diabrotica undecimpunctata howardii*, SCR), and Colorado potato beetle (*Leptinotarsa decemlineata*, CPB), and the Lepidopteran insect pests Corn Earworm (*Helicoverpa zea*, (CEW) also known as Soybean Podworm and Cotton Bollworm), Diamondback Moth (*Plutella xylostella*, DBM), European Corn Borer (*Ostrinia nubilalis*, ECB), Fall Armyworm (*Spodoptera frugiperda*, FAW), Soybean Looper (*Pseudoplusia* includes, SBL), Southwestern Corn Borer (*Diatraea grandiosella*, SWCB), and Velvetbean Caterpillar (*Anticarsia gemmatalis*, VBC).

As described further herein, an ORF encoding TIC7042 (SEQ ID NO:11), was discovered in DNA obtained from *Brevibacillus laterosporus* strain DSC005973 which encodes the protein toxin presented as SEQ ID NO:12. Bioassay using microbial host cell-derived TIC7042 protein demonstrated activity against the Coleopteran pests WCR, WCRHP, NCR, SCR, and CPB, and the Lepidopteran insect pests BCW, CEW, DBM, FAW, SBL, and VBC.

As described further herein, an ORF encoding TIC7381 (SEQ ID NO:13), was discovered in DNA obtained from *Brevibacillus laterosporus* strain DSC006713 which encodes the protein toxin presented as SEQ ID NO:14. Bioassay using microbial host cell-derived TIC7381 protein demonstrated activity against the Coleopteran pests WCR, WCRHP, NCR, SCR, and CPB, and the Lepidopteran insect pests CEW, DBM, ECB, FAW, SBL, SWCB, and VBC.

As described further herein, an ORF encoding TIC7382 (SEQ ID NO:15), was discovered in DNA obtained from *Brevibacillus laterosporus* strain DSC007657 which encodes the protein toxin presented as SEQ ID NO:16. Bioassay using microbial host cell-derived TIC7382 protein demonstrated activity against the Coleopteran pests WCR, WCRHP, NCR, SCR, and CPB, and the Lepidopteran insect pests DBM, ECB, SBL, SWCB, and VBC.

As described further herein, an ORF encoding TIC7383 (SEQ ID NO:17), was discovered in DNA obtained from *Brevibacillus laterosporus* strain DSC008106 which encodes the protein toxin presented as SEQ ID NO:18. Bioassay using microbial host cell-derived TIC7383 protein demonstrated activity against the Coleopteran pests WCR, WCRHP, NCR, SCR, and CPB, and the Lepidopteran insect pests CEW, DBM, ECB, and VBC.

As described further herein, ORF's encoding TIC7386 (SEQ ID NO:29), TIC7388 (SEQ ID NO:31), and TIC7389 (SEQ ID NO:33) were discovered in DNA obtained from *Brevibacillus laterosporus* strains DSC007651, DSC007962, and DSC006878, respectively, and encode the proteins presented herein as SEQ ID NO:30, SEQ ID NO:32, and SEQ ID NO:34. Bioassay using microbial host cell-derived TIC7389 protein demonstrated activity against the Lepidopteran insect pest SBL and Coleopteran pests WCR and CPB.

Further described herein, chymotryptic and tryptic digests of TIC7040HT, and tryptic digests of TIC7383 maintained activity against WCR, relative to the full length TIC7040HT and TIC7383. In addition, truncations of TIC7040HT and TIC7383 maintained activity, and in some cases increased activity, against WCR and CPB, relative to the full length TIC7040HT and TIC7383.

Further described herein are chimeric toxins comprised of domains derived from TIC7381, TIC7382, TIC7383, and TIC7042. The chimeric toxin, TIC10743 (SEQ ID NO:113, encoded by SEQ ID NO:112) is comprised of domains one and two of TIC7383 and domain three of TIC7042. The chimeric toxin, TIC10744 (SEQ ID NO:115, encoded by SEQ ID NO:114) is comprised of domains one and two of TIC7383 and domain three of TIC7381. The chimeric toxin, TIC10745 (SEQ ID NO:117, encoded by SEQ ID NO:116) is comprised of domains one and two of TIC7383 and domain three of TIC7382. The chimeric toxin, TIC10746 (SEQ ID NO:119, encoded by SEQ ID NO:118) is comprised of domains one and two of TIC7382 and domain three of TIC7383. The chimeric toxin, TIC10747 (SEQ ID NO:121, encoded by SEQ ID NO:120) is comprised of domains one and two of TIC7381 and domain three of TIC7383. The chimeric toxin, TIC10748 (SEQ ID NO:123, encoded by SEQ ID NO:122) is comprised of domains one and two of TIC7042 and domain three of TIC7383. The chimeric toxin, TIC10746NTermExt1 (SEQ ID NO:125, encoded by SEQ ID NO:124) is comprised of domains one and two of TIC7382, domain three of TIC7383, and the N-terminal extension of TIC7382. The N-terminal extension of TIC7382 comprises amino acids 1-51 of the TIC7382 toxin protein and is encoded by the first 153 nucleotides of the TIC7382 coding sequence. The chimeric toxin, TIC10746NTermExt2 (SEQ ID NO:127, encoded by SEQ ID NO:126) is comprised of domains one and two of TIC7382, domain three of TIC7383, and the N-terminal extension of TIC7383. The N-terminal extension of TIC7383 comprises amino acids 1-53 of the TIC7383 toxin protein and is encoded by the first 159 nucleotides of the TIC7383 coding sequence.

For expression in plant cells, TIC7040, TIC7040HT, TIC7042, TIC7381, TIC7382, or TIC7383, or variants, truncation variants, or chimeras thereof can be expressed to reside in the cytosol or targeted to various organelles of the plant cell. For example, targeting a protein to the chloroplast may result in increased levels of expressed protein in a transgenic plant while preventing off-phenotypes from occurring. Targeting may also result in an increase in pest resistance efficacy in the transgenic event. A target peptide or transit peptide is a short (3-70 amino acids long) peptide chain that directs the transport of a protein to a specific region in the cell, including the nucleus, mitochondria, endoplasmic reticulum (ER), chloroplast, apoplast, peroxisome and plasma membrane. Some target peptides are cleaved from the protein by signal peptidases after the proteins are transported. For targeting to the chloroplast, proteins contain transit peptides which are around 40-50 amino acids. For descriptions of the use of chloroplast transit peptides, see U.S. Pat. Nos. 5,188,642 and 5,728,925. Many chloroplast-localized proteins are expressed from nuclear genes as precursors and are targeted to the chloroplast by a chloroplast transit peptide (CTP). Examples of such isolated chloroplast proteins include, but are not limited to, those associated with the small subunit (SSU) of ribulose-1,5,-bisphosphate carboxylase, ferredoxin, ferredoxin oxidoreductase, the light-harvesting complex protein I and protein II, thioredoxin F, enolpyruvyl shikimate phosphate synthase (EPSPS), and transit peptides described in U.S. Pat. No. 7,193,133. It has been demonstrated in vivo and in vitro that non-chloroplast proteins may be targeted to the chloroplast by use of protein fusions with a heterologous CTP and that the CTP is sufficient to target a protein to the chloroplast. Incorporation of a suitable chloroplast transit peptide such as the *Arabidopsis thaliana* EPSPS CTP (CTP2) (See, Klee et al., *Mol. Gen. Genet.* 210:437-442, 1987) or the *Petunia hybrida* EPSPS CTP (CTP4) (See, della-Cioppa et al., *Proc. Natl. Acad. Sci. USA* 83:6873-6877, 1986) has been shown to target heterologous EPSPS protein sequences to chloroplasts in transgenic plants (See, U.S. Pat. Nos. 5,627,061; 5,633,435; and 5,312,910; and EP 0218571; EP 189707; EP 508909; and EP 924299). For targeting TIC7040, TIC7040HT, TIC7042, TIC7381, TIC7382, and TIC7383 and variants, truncation variants and chimeras thereof to the chloroplast, a sequence encoding a chloroplast transit peptide is placed 5' in operable linkage and in frame to a synthetic coding sequence encoding the TIC7040, TIC7040HT, TIC7042, TIC7381, TIC7382, and TIC7383 protein, or variants, truncation variants, or chimeras thereof, that has been designed for optimal expression in plant cells.

It is contemplated that additional toxin protein sequences related to TIC7040, TIC7040HT, TIC7042, TIC7381, TIC7382, TIC7383, TIC7386, TIC7388, and TIC7389 can be created by using the naturally occurring amino acid sequence of TIC7040, TIC7040HT, TIC7042, TIC7381, TIC7382, TIC7383, TIC7386, TIC7388, and TIC7389 to create novel proteins and with novel properties. The TIC7040, TIC7040HT, TIC7042, TIC7381, TIC7382, TIC7383, TIC7386, TIC7388, and TIC7389 toxin proteins can be aligned with other proteins similar to TIC7040, TIC7040HT, TIC7042, TIC7381, TIC7382, TIC7383, TIC7386, TIC7388, and TIC7389 to combine differences at the amino acid sequence level into novel amino acid sequence variants and making appropriate changes to the recombinant nucleic acid sequence encoding the variants.

This disclosure further contemplates that improved variants of the TIC7040, TIC7040HT, TIC7042, TIC7381, TIC7382, TIC7383, TIC7386, TIC7388, and TIC7389 protein toxin classes can be engineered in planta by using various gene editing methods known in the art. Such technologies used for genome editing include, but are not limited to, ZFN (zinc-finger nuclease), meganucleases, TALEN (Transcription activator-like effector nucleases), and CRISPR (Clustered Regularly Interspaced Short Palindromic Repeats)/Cas (CRISPR-associated) systems. These genome editing methods can be used to alter the toxin protein coding sequence transformed within a plant cell to a different toxin coding sequence. Specifically, through these methods, one or more codons within the toxin coding sequence is altered to engineer a new protein amino acid sequence. Alternatively, a fragment within the coding sequence is replaced or deleted, or additional DNA fragments are inserted into the coding sequence, to engineer a new toxin coding sequence. The new coding sequence can encode a toxin protein with new properties such as increased activity or spectrum against insect pests, as well as provide activity against an insect pest species wherein resistance has developed against the original insect toxin protein. The plant cell comprising the gene edited toxin coding sequence can be used by methods known in the art to generate whole plants expressing the new toxin protein.

It is also contemplated that fragments of the TIC7040, TIC7040HT, TIC7042, TIC7381, TIC7382, TIC7383, TIC7386, TIC7388, and TIC7389 proteins or protein variants thereof can be truncated forms wherein one or more amino acids are deleted from the N-terminal end, C-terminal end, the middle of the protein, or combinations thereof with insect inhibitory activity. These fragments can be naturally occurring or synthetic variants of TIC7040, TIC7040HT, TIC7042, TIC7381, TIC7382, TIC7383, TIC7386, TIC7388, and TIC7389 or protein variants thereof, but should retain the insect inhibitory activity of TIC7040, TIC7040HT, TIC7042, TIC7381, TIC7382, TIC7383, TIC7386, TIC7388, and TIC7389.

Proteins that resemble the TIC7040, TIC7040HT, TIC7042, TIC7381, TIC7382, TIC7383, TIC7386, TIC7388, and TIC7389 proteins can be identified by comparison to each other using various computer-based algorithms known in the art. For example, amino acid sequence identities of proteins related to TIC7040, TIC7040HT, TIC7042, TIC7381, TIC7382, TIC7383, TIC7386, TIC7388, and TIC7389 can be analyzed using a Clustal W alignment using these default parameters: Weight matrix: blosum, Gap opening penalty: 10.0, Gap extension penalty: 0.05, Hydrophilic gaps: On, Hydrophilic residues: GPSNDQERK, Residue-specific gap penalties: On (Thompson, et al (1994) Nucleic Acids Research, 22:4673-4680). Percent amino acid identity is further calculated by the product of 100% multiplied by (amino acid identities/length of subject protein). Other alignment algorithms are also available in the art and provide results similar to those obtained using a Clustal W alignment.

It is intended that a protein exhibiting insect inhibitory activity against a Lepidopteran or Coleopteran insect species is related to TIC7040, TIC7040HT, TIC7042, TIC7381, TIC7382, TIC7383, TIC7386, TIC7388, and TIC7389 if alignment of such query protein with TIC7383 or TIC7386 exhibits at least 75% to about 100% amino acid identity along the length of the query protein that is about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100% amino acid sequence identity (or any fraction of a percentage in this range) between query and subject protein; or if alignment of such query protein with TIC7040HT, TIC7381, or TIC7389 exhibits at least 90% to about 100% amino acid identity along the length of the query protein that is about 90%, 91%, 92%, 93%, 94%, 95%, 96%, 97%, 98%, 99%, 100% amino acid sequence identity (or any fraction of a percentage in this range) between query and subject protein; or if alignment of such query protein with TIC7042, or TIC7382 exhibits at least 93% to about 100% amino acid identity along the length of the query protein that is about 93%, 94%, 95%, 96%, 97%, 98%, 99%, 100% amino acid sequence identity (or any fraction of a percentage in this range) between query and subject protein; or if alignment of such query protein with TIC7040HT, TIC7381, or TIC7388 exhibits at least 99% to about 100% amino acid identity along the length of the query protein (or any fraction of a percentage in this range) between query and subject protein.

Exemplary proteins TIC7040, TIC7040HT, TIC7042, TIC7381, TIC7382, TIC7383, TIC7386, TIC7388, and TIC7389 were aligned with each other using a Clustal W algorithm. A pair-wise matrix of percent amino acid sequence identities for each of the full-length proteins was created, as reported in Table 1. The number of identical amino acids between two sequences is indicated in parenthesis.

TABLE 1

Pair-wise matrix display of exemplary proteins TIC7040, TIC7040HT, TIC7042, TIC7381, TIC7382, TIC7383, TIC7386, TIC7388, and TIC7389.

| Toxin | TIC7042 SEQ ID NO: 12 | TIC7386 SEQ ID NO: 30 | TIC7388 SEQ ID NO: 32 | TIC7382 SEQ ID NO: 16 | TIC7040 SEQ ID NO: 2 | TIC7040HT SEQ ID NO: 4 | TIC7381 SEQ ID NO: 14 | TIC7389 SEQ ID NO: 34 | TIC7383 SEQ ID NO: 18 |
|---|---|---|---|---|---|---|---|---|---|
| TIC7042 SEQ ID NO: 12 | — | 99.1 (1254) | 92.3 (1169) | 87.8 (1111) | 85.7 (1085) | 86.3 (1093) | 86.7 (1097) | 86.7 (1098) | 73.3 (928) |
| TIC7386 SEQ ID NO: 30 | 98 (1254) | — | 91.5 (1170) | 86.7 (1109) | 85.1 (1089) | 85.7 (1096) | 86 (1100) | 86.1 (1101) | 72.6 (928) |
| TIC7388 SEQ ID NO: 32 | 92.1 (1169) | 92.2 (1170) | — | 93.7 (1189) | 88.8 (1127) | 89.4 (1135) | 89.8 (1140) | 89.9 (1141) | 76.1 (966) |
| TIC7382 SEQ ID NO: 16 | 89.2 (1111) | 89 (1109) | 95.4 (1189) | — | 90.6 (1129) | 91.4 (1139) | 91.2 (1136) | 91.5 (1140) | 76.2 (949) |
| TIC7040 SEQ ID NO: 2 | 86.2 (1085) | 86.5 (1089) | 89.5 (1127) | 89.7 (1129) | — | 99.9 (1258) | 98.5 (1240) | 99 (1247) | 76.6 (965) |
| TIC7040HT SEQ ID NO: 4 | 84.4 (1093) | 84.6 (1096) | 87.6 (1135) | 88 (1139) | 97.1 (1258) | — | 96.6 (1251) | 97.2 (1259) | 74.8 (969) |
| TIC7381 SEQ ID NO: 14 | 86.4 (1097) | 86.7 (1100) | 89.8 (1140) | 89.5 (1136) | 97.7 (1240) | 98.6 (1251) | — | 99.5 (1263) | 76.5 (971) |
| TIC7389 SEQ ID NO: 34 | 83.2 (1098) | 83.5 (1101) | 86.5 (1141) | 86.4 (1140) | 94.5 (1247) | 95.5 (1259) | 95.8 (1263) | — | 73.9 (975) |
| TIC7383 SEQ ID NO: 18 | 73.9 (928) | 73.9 (928) | 76.9 (966) | 75.6 (949) | 76.8 (965) | 77.1 (969) | 77.3 (971) | 77.6 (975) | — |

In addition to percent identity, the TIC7040, TIC7040HT, TIC7042, TIC7381, TIC7382, TIC7383, TIC7386, TIC7388, and TIC7389 proteins can also be related by primary structure (conserved amino acid motifs), by length (about 1243 to about 1259 amino acids) and by other characteristics. Bioinformatic analysis suggests that TIC7040, TIC7040HT, TIC7042, TIC7381, TIC7382, TIC7383, TIC7386, TIC7388, and TIC7389 belong to the Cry43 family of proteins. Characteristics of the TIC7040, TIC7040HT, TIC7042, TIC7381, TIC7382, TIC7383, TIC7386, TIC7388, and TIC7389 proteins are reported in Table 2.

TABLE 2

Selected characteristics of the TIC7040, TIC7040HT, TIC7042, TIC7381, TIC7382, TIC7383, TIC7386, TIC7388, and TIC7389 proteins and related family member proteins.

| Protein | Molecular Weight (in Daltons) | Amino Acid Length | Isoelectric Point | Charge at PH 7.0 | No. of Strongly Basic (−) Amino Acids | No. of Strongly Acidic Amino Acids | No. of Hydrophobic Amino Acids | No. of Polar Amino Acids |
|---|---|---|---|---|---|---|---|---|
| TIC7040 | 142822.03 | 1259 | 5.8063 | −13.0 | 154 | 151 | 618 | 641 |
| TIC7040HT | 146821.27 | 1295 | 5.8643 | −14.0 | 161 | 156 | 636 | 659 |
| TIC7040_4 | 75400.92 | 671 | 7.0053 | 2.5 | 68 | 61 | 333 | 338 |
| TIC7040_5 | 67268.98 | 600 | 7.5498 | 4.0 | 61 | 53 | 303 | 297 |
| TIC7040_6 | 74075.56 | 660 | 7.0051 | 2.5 | 67 | 60 | 332 | 338 |
| TIC7040HT_Tryp | 65150.72 | 582 | 8.1625 | 5.5 | 59 | 50 | 294 | 288 |
| TIC7040HT_Chymo | 66845.58 | 597 | 7.8790 | 4.5 | 59 | 51 | 302 | 295 |
| CR-BREla.TIC7040_1.nno_Mc:1 | 71805.04 | 640 | 6.7230 | 1.0 | 62 | 57 | 325 | 315 |

TABLE 2-continued

Selected characteristics of the TIC7040, TIC7040HT, TIC7042, TIC7381, TIC7382, TIC7383, TIC7386, TIC7388, and TIC7389 proteins and related family member proteins.

| Protein | Molecular Weight (in Daltons) | Amino Acid Length | Isoelectric Point | Charge at PH 7.0 | No. of Strongly Basic (−) Amino Acids | No. of Strongly Acidic Amino Acids | No. of Hydrophobic Amino Acids | No. of Polar Amino Acids |
|---|---|---|---|---|---|---|---|---|
| CR-BREla.TIC7040_11.nno_Mc:1 | 65281.91 | 583 | 8.1625 | 5.5 | 59 | 50 | 295 | 288 |
| CR-BREla.TIC7040_12.nno_Mc:2 | 74125.45 | 660 | 6.5260 | 0.0 | 64 | 60 | 329 | 331 |
| CR-BREla.TIC7040_13.nno_Mc:1 | 69983.90 | 624 | 7.2157 | 3.0 | 62 | 55 | 310 | 314 |
| CR-BREla.TIC7040_14.nno_Mc:1 | 68315.18 | 611 | 6.8814 | 1.5 | 59 | 54 | 311 | 300 |
| TIC7042 | 143469.54 | 1266 | 6.1143 | −9.0 | 158 | 148 | 617 | 649 |
| CR-BREla.TIC7042_1.nno_Mc:1 | 71715.51 | 637 | 6.6825 | 1.0 | 62 | 56 | 312 | 325 |
| CR-BREla.TIC7042_2.nno_Mc:1 | 73986.03 | 657 | 6.9127 | 2.5 | 67 | 59 | 319 | 338 |
| TIC7381 | 143793.24 | 1269 | 6.2077 | −7.0 | 162 | 150 | 626 | 643 |
| CR-BREla.TIC7381_1.nno_Mc:1 | 143850.30 | 1270 | 6.2077 | −7.0 | 162 | 150 | 627 | 643 |
| CR-BREla.TIC7381_2.nno_Mc:1 | 73892.21 | 659 | 6.5260 | 0.0 | 64 | 60 | 331 | 328 |
| CR-BREla.TIC7381_3.nno_Mc:1 | 68253.10 | 611 | 6.8814 | 1.5 | 59 | 54 | 312 | 299 |
| TIC7382 | 140890.86 | 1246 | 5.7572 | −13.0 | 149 | 147 | 614 | 632 |
| CR-BREla.TIC7382_1.nno_Mc:1 | 140961.94 | 1247 | 5.7572 | −13.0 | 149 | 147 | 615 | 632 |
| CR-BREla.TIC7382_2.nno_Mc:1 | 73858.00 | 660 | 6.6112 | 0.5 | 63 | 58 | 329 | 331 |
| CR-BREla.TIC7382_3.nno_Mc:1 | 67924.61 | 610 | 6.9577 | 2.0 | 58 | 52 | 310 | 300 |
| TIC7383 | 142470.64 | 1256 | 5.5492 | −17.5 | 151 | 152 | 627 | 629 |
| TIC7383_2 | 140903.05 | 1243 | 5.5471 | −17.5 | 150 | 151 | 626 | 617 |
| TIC7383_3 | 74526.97 | 659 | 5.7950 | −3.0 | 61 | 61 | 343 | 316 |
| TIC7383_4 | 76846.56 | 679 | 5.9941 | −2.5 | 66 | 65 | 350 | 329 |
| TIC7383_5 | 72959.38 | 646 | 5.7903 | −3.0 | 60 | 60 | 342 | 304 |
| TIC7383_6 | 75278.97 | 666 | 5.9913 | −2.5 | 65 | 64 | 349 | 317 |
| TIC7383_Tryp | 69242.24 | 614 | 5.8225 | −2.5 | 57 | 57 | 326 | 288 |
| CR-BREla.TIC7383_1.nno_Mc:1 | 142541.72 | 1257 | 5.5492 | −17.5 | 151 | 152 | 628 | 629 |
| CR-BREla.TIC7383_7.nno_Mc:1 | 69545.62 | 617 | 5.8225 | −2.5 | 57 | 57 | 328 | 289 |
| CR-BREla.TIC7383_8.nno_Mc:1 | 74772.20 | 662 | 5.7950 | −3.0 | 61 | 61 | 344 | 318 |
| CR-BREla.TIC7383_9.nno_Mc:1 | 75669.20 | 669 | 5.5878 | −4.0 | 62 | 63 | 347 | 322 |
| CR-BREla.TIC7383_19.nno_Mc:1 | 74030.53 | 655 | 5.5815 | −4.0 | 61 | 62 | 345 | 310 |
| CR-BREla.TIC7383_20.nno_Mc:1 | 73133.53 | 648 | 5.7903 | −3.0 | 60 | 60 | 342 | 306 |
| CR-BREla.TIC7383_21.nno_Mc:1 | 68648.63 | 610 | 6.0997 | −1.5 | 56 | 55 | 325 | 285 |
| CR-BREla.TIC7383_22.nno_Mc:1 | 69474.54 | 616 | 5.8225 | −2.5 | 57 | 57 | 327 | 289 |
| CR-BREla.TIC7383_23.nno_Mc:1 | 68577.55 | 609 | 6.0997 | −1.5 | 56 | 55 | 324 | 285 |
| CR-BREla.TIC7383_24.nno_Mc:2 | 66643.51 | 590 | 6.6807 | 0.5 | 55 | 52 | 315 | 275 |
| CR-BREla.TIC7383_25.nno_Mc:3 | 64647.09 | 569 | 6.3851 | −0.5 | 54 | 52 | 299 | 270 |
| CR-BREla.TIC7383_26.nno_Mc:1 | 62376.52 | 549 | 6.6802 | 0.5 | 54 | 51 | 287 | 262 |
| CR-BREla.TIC7383_27.nno_Mc:1 | 68417.42 | 607 | 6.0997 | −1.5 | 56 | 55 | 324 | 283 |
| CR-BREla.TIC7383_28.nno_Mc:1 | 72902.33 | 645 | 5.7903 | −3.0 | 60 | 60 | 341 | 304 |
| CR-BREla.TIC7383_29.nno_Mc:1 | 108909.43 | 964 | 5.0905 | −17.0 | 104 | 112 | 489 | 475 |
| CR-BREla.TIC7383_30.nno_Mc:1 | 142342.42 | 1257 | 5.3793 | −20.5 | 148 | 152 | 631 | 626 |
| CR-BREla.TIC7383_31.nno_Mc:1 | 120993.09 | 1066 | 5.4956 | −13.0 | 122 | 124 | 538 | 528 |
| CR-BREla.TIC7383_32.nno_Mc:1 | 141715.71 | 1251 | 5.3252 | −21.5 | 146 | 151 | 628 | 623 |
| TIC7386 | 144952.03 | 1279 | 6.1338 | −9.0 | 161 | 150 | 621 | 658 |
| TIC7388 | 143562.87 | 1269 | 6.0794 | −9.5 | 157 | 148 | 629 | 640 |
| TIC7389 | 149398.97 | 1319 | 5.6940 | −17.5 | 162 | 160 | 652 | 667 |
| GOI-TIC10743.nno_Mc:1 | 69704.53 | 617 | 6.0297 | −2.0 | 57 | 56 | 314 | 303 |
| GOI-TIC10744.nno_Mc:1 | 69405.21 | 616 | 6.0308 | −2.0 | 57 | 56 | 317 | 299 |
| GOI-TIC10745.nno_Mc:1 | 69732.59 | 617 | 6.2812 | −1.0 | 58 | 56 | 314 | 303 |
| GOI-TIC10746.nno_Mc:1 | 67737.64 | 610 | 6.6433 | 0.5 | 57 | 53 | 324 | 286 |
| GOI-TIC10747.nno_Mc:1 | 68393.51 | 612 | 6.8012 | 1.0 | 59 | 58 | 323 | 289 |
| GOI-TIC10748.nno_Mc:1 | 68118.77 | 609 | 6.7284 | 1.0 | 59 | 54 | 312 | 297 |
| TIC10746NTermExt1 | 73599.95 | 659 | 6.3342 | −1.0 | 62 | 59 | 342 | 317 |
| TIC10746NTermExt2 | 73790.14 | 661 | 6.3342 | −1.0 | 62 | 59 | 342 | 319 |

As described further in the Examples of this application, recombinant nucleic acid molecule sequences encoding TIC7040, TIC7040HT, TIC7042, TIC7381, TIC7382, and TIC7383, and variants, truncation variants, and chimeras thereof were designed for use in plants. Exemplary plant-optimized recombinant nucleic acid molecule sequences that were designed for use in plants are presented in Table 8 of Example 5, along with the corresponding nucleotide and protein sequences, description and modifications.

Expression cassettes and vectors containing these recombinant nucleic acid molecule sequences can be constructed and introduced into corn, soybean, cotton or other plant cells in accordance with transformation methods and techniques known in the art. For example, Agrobacterium-mediated transformation is described in U.S. Patent Application Publications 2009/0138985A1 (soybean), 2008/0280361A1 (soybean), 2009/0142837A1 (corn), 2008/0282432 (cotton), 2008/0256667 (cotton), 2003/0110531 (wheat), 2001/0042257 A1 (sugar beet), U.S. Pat. No. 5,750,871 (canola), U.S. Pat. No. 7,026,528 (wheat), and U.S. Pat. No. 6,365,807 (rice), and in Arencibia et al. (1998) Transgenic Res. 7:213-222 (sugarcane), all of which are incorporated herein by reference in their entirety. Transformed cells can be regenerated into transformed plants that express TIC7040, TIC7040HT, TIC7042, TIC7381, TIC7382, or TIC7383. To test pesticidal activity, bioassays are performed in the presence of Lepidoptera pest larvae using plant leaf disks obtained from transformed plants, as described in the Examples. To test pesticidal activity against Coleopteran pests, transformed plants of $R_o$ and $F_1$ generation are used in root worm assay, as described in the Examples. To test pesticidal activity against Hemipteran pests, pods, corn ears or leaves of transformed plants are used in assay, either from tissue removed from the plant or remaining on the plant as described in the Examples.

As an alternative to traditional transformation methods, a DNA sequence, such as a transgene, expression cassette(s), etc., may be inserted or integrated into a specific site or locus within the genome of a plant or plant cell via site-directed integration. Recombinant DNA construct(s) and molecule(s) of this disclosure may thus include a donor template sequence comprising at least one transgene, expression cassette, or other DNA sequence for insertion into the genome of the plant or plant cell. Such donor template for site-directed integration may further include one or two homology arms flanking an insertion sequence (i.e., the sequence, transgene, cassette, etc., to be inserted into the plant genome). The recombinant DNA construct(s) of this disclosure may further comprise an expression cassette(s) encoding a site-specific nuclease and/or any associated protein(s) to carry out site-directed integration. These nuclease expressing cassette(s) may be present in the same molecule or vector as the donor template (in cis) or on a separate molecule or vector (in trans). Several methods for site-directed integration are known in the art involving different proteins (or complexes of proteins and/or guide RNA) that cut the genomic DNA to produce a double strand break (DSB) or nick at a desired genomic site or locus. As understood in the art, during the process of repairing the DSB or nick introduced by the nuclease enzyme, the donor template DNA may become integrated into the genome at the site of the DSB or nick. The presence of the homology arm(s) in the donor template may promote the adoption and targeting of the insertion sequence into the plant genome during the repair process through homologous recombination, although an insertion event may occur through non-homologous end joining (NHEJ). Examples of site-specific nucleases that may be used include zinc-finger nucleases, engineered or native meganucleases, TALE-endonucleases, and RNA-guided endonucleases (e.g., Cas9 or Cpf1). For methods using RNA-guided site-specific nucleases (e.g., Cas9 or Cpf1), the recombinant DNA construct(s) will also comprise a sequence encoding one or more guide RNAs to direct the nuclease to the desired site within the plant genome.

Recombinant nucleic acid molecule compositions that encode TIC7040, TIC7040HT, TIC7042, TIC7381, TIC7382, TIC7383, TIC7386, TIC7388, and TIC7389 or related family member insecticidal proteins are contemplated. For example, TIC7040, TIC7040HT, TIC7042, TIC7381, TIC7382, TIC7383, TIC7386, TIC7388, and TIC7389 or related family member insecticidal proteins can be expressed with recombinant DNA constructs in which a polynucleotide molecule with an ORF encoding the protein is operably linked to genetic expression elements such as a promoter and any other regulatory element necessary for expression in the system for which the construct is intended. Non-limiting examples include a plant-functional promoter operably linked to the TIC7040, TIC7040HT, TIC7042, TIC7381, TIC7382, TIC7383, TIC7386, TIC7388, and TIC7389 or related family member insecticidal protein encoding sequences for expression of the protein in plants or a Bt-functional promoter operably linked to a TIC7040, TIC7040HT, TIC7042, TIC7381, TIC7382, TIC7383, TIC7386, TIC7388, and TIC7389 or related family member insecticidal protein encoding sequences for expression of the protein in a Bt bacterium or other *Bacillus* species. Other elements can be operably linked to the TIC7040, TIC7040HT, TIC7042, TIC7381, TIC7382, TIC7383, TIC7386, TIC7388, and TIC7389 or related family member insecticidal protein encoding sequences including, but not limited to, enhancers, introns, untranslated leaders, encoded protein immobilization tags (HIS-tag), translocation peptides (i.e., plastid transit peptides, signal peptides), polypeptide sequences for post-translational modifying enzymes, ribosomal binding sites, and RNAi target sites. Exemplary recombinant polynucleotide molecules provided herewith include, but are not limited to, a heterologous promoter operably linked to a polynucleotide such as SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, and SEQ ID NO:126 that encodes a polypeptide or protein having the amino acid sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:43, SEQ ID NO:46, SEQ ID NO:48, SEQ ID NO:50, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, and SEQ ID NO:127. A heterologous promoter can also be operably linked to synthetic DNA coding sequences encoding a plastid targeted or untargeted TIC7040, TIC7040HT, TIC7042, TIC7381, TIC7382, TIC7383, variants, truncation variants, and chimeras thereof and untargeted TIC7040, TIC7040HT, TIC7042, TIC7381, TIC7382, TIC7383, variants, truncation variants, and chimeras thereof or related family member insecticidal proteins. The codons of a recombinant nucleic acid molecule encoding for proteins disclosed herein can be substituted by synonymous codons (known in the art as a silent substitution).

A recombinant DNA construct comprising an encoding sequence for TIC7040, TIC7040HT, TIC7042, TIC7381, TIC7382, TIC7383, TIC7386, TIC7388, TIC7389 or related family member insecticidal protein can further comprise a region of DNA that encodes for one or more insect inhibitory agents which can be configured to concomitantly express or co-express with a DNA sequence encoding a TIC7040, TIC7040HT, TIC7042, TIC7381, TIC7382, TIC7383, TIC7386, TIC7388, TIC7389 or related family member insecticidal protein, a protein different from a TIC7040, TIC7040HT, TIC7042, TIC7381, TIC7382, TIC7383, TIC7386, TIC7388, TIC7389 or a related family member insecticidal protein, an insect inhibitory dsRNA molecule, or an ancillary protein. Ancillary proteins include, but are not limited to, co-factors, enzymes, binding-partners, or other agents that function to aid in the effectiveness of an insect inhibitory agent, for example, by aiding its expression, influencing its stability in plants, optimizing free energy for oligomerization, augmenting its toxicity, and increasing its spectrum of activity. An ancillary protein may facilitate the uptake of one or more insect inhibitory agents, for example, or potentiate the toxic effects of the toxic agent.

A recombinant DNA construct can be assembled so that all proteins or dsRNA molecules are expressed from one promoter or each protein or dsRNA molecules is under separate promoter control or some combination thereof. The TIC7040, TIC7040HT, TIC7042, TIC7381, TIC7382, TIC7383, TIC7386, TIC7388, TIC7389 and related family member proteins of this invention can be expressed from a multi-gene expression system in which one or more TIC7040, TIC7040HT, TIC7042, TIC7381, TIC7382, TIC7383, TIC7386, TIC7388, TIC7389 or related family member proteins is expressed from a common nucleotide segment which also contains other open reading frames and promoters, depending on the type of expression system selected. For example, a bacterial multi-gene expression system can utilize a single promoter to drive expression of multiply-linked/tandem open reading frames from within a single operon (i.e., polycistronic expression). In another example, a plant multi-gene expression system can utilize multiply-unlinked expression cassettes each expressing a different protein or other agent such as one or more dsRNA molecules.

Recombinant nucleic acid molecules or recombinant DNA constructs comprising a TIC7040, TIC7040HT, TIC7042, TIC7381, TIC7382, TIC7383, TIC7386, TIC7388, TIC7389 or related family member protein encoding sequence can be delivered to host cells by vectors, e.g., a plasmid, baculovirus, synthetic chromosome, virion, cosmid, phagemid, phage, or viral vector. Such vectors can be used to achieve stable or transient expression of a TIC7040, TIC7040HT, TIC7042, TIC7381, TIC7382, TIC7383, TIC7386, TIC7388, TIC7389 or related family member protein encoding sequence in a host cell, or subsequent expression of the encoded polypeptide. An exogenous recombinant polynucleotide or recombinant DNA construct that comprises a protein encoding sequence and that is introduced into a host cell is referred herein as a "transgene."

Transgenic bacteria, transgenic plant cells, transgenic plants, and transgenic plant parts that contain a recombinant polynucleotide that expresses any one or more of the TIC7040, TIC7040HT, TIC7042, TIC7381, TIC7382, TIC7383, TIC7386, TIC7388, TIC7389 or related family member protein encoding sequences are provided herein. The term "bacterial cell" or "bacterium" can include, but is not limited to, an *Agrobacterium*, a *Bacillus*, an *Escherichia*, a *Salmonella*, a *Pseudomonas*, or a *Rhizobium* cell. The term "plant cell" or "plant" can include but is not limited to a dicotyledonous cell or a monocotyledonous cell. Contemplated plants and plant cells include, but are not limited to, alfalfa, banana, barley, bean, broccoli, cabbage, brassica, carrot, cassava, castor, cauliflower, celery, chickpea, Chinese cabbage, citrus, coconut, coffee, corn, clover, cotton, a cucurbit, cucumber, Douglas fir, eggplant, eucalyptus, flax, garlic, grape, hops, leek, lettuce, Loblolly pine, millets, melons, nut, oat, olive, onion, ornamental, palm, pasture grass, pea, peanut, pepper, pigeonpea, pine, potato, poplar, pumpkin, Radiata pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and wheat plant cell or plant. In certain embodiments, transgenic plants and transgenic plant parts regenerated from a transgenic plant cell are provided. In certain embodiments, the transgenic plants can be obtained from a transgenic seed, by cutting, snapping, grinding or otherwise disassociating the part from the plant. In certain embodiments, the plant part can be a seed, a boll, a leaf, a flower, a stem, a root, or any portion thereof, or a non-regenerable portion of a transgenic plant part. As used in this context, a "non-regenerable" portion of a transgenic plant part is a portion that cannot be induced to form a whole plant or that cannot be induced to form a whole plant that is capable of sexual and/or asexual reproduction. In certain embodiments, a non-regenerable portion of a plant part is a portion of a transgenic seed, boll, leaf, flower, stem, or root.

Methods of making transgenic plants that comprise insect, Coleoptera- or Lepidoptera-inhibitory amounts of a TIC7040, TIC7040HT, TIC7042, TIC7381, TIC7382, TIC7383, TIC7386, TIC7388, TIC7389, variant, truncation variant, chimera or related family member protein are provided. Such plants can be made by introducing a recombinant polynucleotide that encodes any TIC7040, TIC7040HT, TIC7042, TIC7381, TIC7382, TIC7383, TIC7386, TIC7388, TIC7389, variant, truncation variant, chimera or related family member protein provided in this application into a plant cell, and selecting a plant derived from said plant cell that expresses an insect, Coleoptera- or Lepidoptera-inhibitory amount of the proteins. Plants can be derived from the plant cells by regeneration, seed, pollen, or meristem transformation techniques. Methods for transforming plants are known in the art.

Processed plant products, wherein the processed product comprises a detectable amount of a TIC7040, TIC7040HT, TIC7042, TIC7381, TIC7382, TIC7383, TIC7386, TIC7388, TIC7389, variant, truncation variant, chimera or related family member protein, an insect inhibitory segment or fragment thereof, or any distinguishing portion thereof, are also disclosed in this application. In certain embodiments, the processed product is selected from the group consisting of plant parts, plant biomass, oil, meal, sugar, animal feed, flour, flakes, bran, lint, hulls, processed seed, and seed. In certain embodiments, the processed product is non-regenerable. The plant product can comprise commodity or other products of commerce derived from a transgenic plant or transgenic plant part, where the commodity or other products can be tracked through commerce by detecting nucleotide segments or expressed RNA or proteins that encode or comprise distinguishing portions of a TIC7040, TIC7040HT, TIC7042, TIC7381, TIC7382, TIC7383, TIC7386, TIC7388, TIC7389, variant, truncation variant, chimera or related family member protein.

Plants expressing a TIC7040, TIC7040HT, TIC7042, TIC7381, TIC7382, TIC7383, TIC7386, TIC7388, TIC7389, variant, truncation variant, chimera or related family member protein can be crossed by breeding with transgenic events expressing other toxin proteins and/or expressing other transgenic traits such as herbicide tolerance genes, genes conferring yield or stress tolerance traits, and the like, or such traits can be combined in a single vector so that the traits are all linked.

As described further in the Examples, sequences encoding TIC7040, TIC7040HT, TIC7042, TIC7381, TIC7382, and TIC7383, variants of TIC7040HT, TIC7042, TIC7381, TIC7382, and TIC7383, truncation variants of TIC7040HT, TIC7042, TIC7381, TIC7382, and TIC7383, and chimeras of TIC7383, TIC7042, TIC7381 and TIC7382 were designed for use in plants and are presented in Table 8 in Example 5.

Expression cassettes and vectors containing these synthetic or artificial nucleotide sequences can be constructed and introduced into corn, cotton, and soybean plant cells in accordance with transformation methods and techniques which are known in the art. Transformed cells are regenerated into transformed plants that are observed to be expressing TIC7040, TIC7040HT, TIC7042, TIC7381, TIC7382, or TIC7383; or variants, truncation variants or chimeras thereof. To test pesticidal activity, bioassays are performed in the presence of Lepidopteran, Coleopteran and Hemipteran pests.

As further described in the Examples, sequences encoding TIC7040, TIC7040HT, TIC7042, TIC7381, TIC7382, TIC7383, variants, truncation variants, chimeras or related family member proteins and sequences having a substantial percentage identity to these proteins can be identified using methods known to those of ordinary skill in the art such as polymerase chain reaction (PCR), thermal amplification and hybridization. For example, a TIC7040, TIC7040HT, TIC7042, TIC7381, TIC7382, or TIC7383 protein and variants, truncation variants, chimeras or related family member proteins can be used to produce antibodies that bind specifically to related proteins, and can be used to screen for and to find other protein members that are closely related.

Furthermore, nucleotide sequences encoding TIC7040, TIC7040HT, TIC7042, TIC7381, TIC7382, or TIC7383 and variants, truncation variants, chimeras or related family member proteins can be used as probes and primers for screening to identify other members of the class using thermal-cycle or isothermal amplification and hybridization methods. For example, oligonucleotides derived from sequences as set forth as SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, and SEQ ID NO:126 can be used to determine the presence or absence of a TIC7040, TIC7040HT, TIC7042, TIC7381, TIC7382, or TIC7383 protein, or variants, truncation variants, chimeras, or related family member protein transgene in a deoxyribonucleic acid sample derived from a commodity product. Given the sensitivity of certain nucleic acid detection methods that employ oligonucleotides, it is anticipated that oligonucleotides derived from the sequences as set forth as SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, and SEQ ID NO:126 can be used to detect a TIC7040, TIC7040HT, TIC7042, TIC7381, TIC7382, or TIC7383, variants, truncation variants, or chimeric transgenes thereof in commodity products derived from pooled sources where only a fraction of the commodity product is derived from a transgenic plant containing any of SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, or SEQ ID NO:126. It is further recognized that such oligonucleotides can be used to introduce nucleotide sequence variation in SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, or SEQ ID NO:126. Such "mutagenesis" oligonucleotides are useful for identification of TIC7040, TIC7040HT, TIC7042, TIC7381, TIC7382, TIC7383, TIC7386, TIC7388, TIC7389 or related family member amino acid sequence variants exhibiting a range of insect inhibitory activity or varied expression in transgenic plant host cells.

Nucleotide sequence homologs, e.g., insecticidal proteins encoded by nucleotide sequences that hybridize to each or any of the sequences disclosed in this application under hybridization conditions, are also an embodiment of the present invention. The invention also provides a method for detecting a first nucleotide sequence that hybridizes to a second nucleotide sequence, wherein the first nucleotide sequence (or its reverse complement sequence) encodes a pesticidal protein or pesticidal fragment thereof and hybridizes under stringent hybridization conditions to the second nucleotide sequence. In such case, the second nucleotide sequence can be the nucleotide sequence selected from the group consisting of: SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:44, SEQ ID NO:45, SEQ ID NO:47, SEQ ID NO:49, SEQ ID NO:51, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, and SEQ ID NO:126 under stringent hybridization conditions. Nucleotide coding sequences hybridize to one another under appropriate hybridization conditions and the proteins encoded by these nucleotide sequences cross react with antiserum raised against any one of the other proteins. Stringent hybridization conditions, as defined herein, comprise at least hybridization at 42° C. followed by two washes for five minutes each at room temperature with 2×SSC, 0.1% SDS, followed by two washes for thirty minutes each at 65° C. in 0.5×SSC, 0.1% SDS. Washes at even higher temperatures constitute even more stringent conditions, e.g., hybridization conditions of 68° C., followed by washing at 68° C., in 2×SSC containing 0.1% SDS.

One skilled in the art will recognize that, due to the redundancy of the genetic code, many other sequences are capable of encoding proteins related to TIC7040, TIC7040HT, TIC7042, TIC7381, TIC7382, TIC7383, TIC7386, TIC7388, or TIC7389, and those sequences, to the extent that they function to express pesticidal proteins either in *Bacillus* strains or in plant cells, are embodiments of the present invention, recognizing of course that many such redundant coding sequences will not hybridize under these conditions to the native *Brevibacillus* sequences encoding TIC7040, TIC7040HT, TIC7042, TIC7381, TIC7382, TIC7383, TIC7386, TIC7388, or TIC7389. This application contemplates the use of these and other identification methods known to those of ordinary skill in the art, to identify TIC7040, TIC7040HT, TIC7042, TIC7381, TIC7382, TIC7383, TIC7386, TIC7388, TIC7389 or related family member protein-encoding sequences and sequences having a substantial percentage identity thereto.

Methods of controlling insects, in particular Lepidoptera or Coleoptera infestations of crop plants, with the TIC7040, TIC7040HT, TIC7042, TIC7381, TIC7382, TIC7383, TIC7386, TIC7388, or TIC7389 or related family member proteins are also disclosed in this application. Such methods can comprise growing a plant comprising an insect-, Coleoptera-, or Lepidoptera-inhibitory amount of a TIC7040, TIC7040HT, TIC7042, TIC7381, TIC7382, TIC7383, TIC7386, TIC7388, TIC7389, variant, truncation variant, chimera or related family member toxin protein. In certain embodiments, such methods can further comprise any one or more of: (i) applying any composition comprising or encoding a TIC7040, TIC7040HT, TIC7042, TIC7381, TIC7382, TIC7383, TIC7386, TIC7388, TIC7389, variant, truncation variant, chimera or related family member toxin protein to a plant or a seed that gives rise to a plant; and (ii) transforming a plant or a plant cell that gives rise to a plant with a polynucleotide encoding a TIC7040, TIC7040HT, TIC7042, TIC7381, TIC7382, TIC7383, TIC7386, TIC7388, TIC7389, variant, truncation variant, chimera or related family member toxin protein. In general, it is contemplated that a TIC7040, TIC7040HT, TIC7042, TIC7381, TIC7382, TIC7383, TIC7386, TIC7388, TIC7389, variant, truncation variant or related family member toxin protein can be provided in a composition, provided in a microorganism, or provided in a transgenic plant to confer insect inhibitory activity against Lepidopteran or Coleopteran insects.

In certain embodiments, a recombinant nucleic acid molecule of a TIC7040, TIC7040HT, TIC7042, TIC7381, TIC7382, TIC7383, TIC7386, TIC7388, TIC7389, variant, truncation variant, chimera or related family member toxin protein is the insecticidally active ingredient of an insect inhibitory composition prepared by culturing recombinant *Bacillus* or any other recombinant bacterial cell transformed to express the protein. Such a composition can be prepared by desiccation, lyophilization, homogenization, extraction, filtration, centrifugation, sedimentation, or concentration of a culture of such recombinant cells expressing/producing said recombinant polypeptide. Such a process can result in a *Bacillus* or other entomopathogenic bacterial cell extract, cell suspension, cell homogenate, cell lysate, cell supernatant, cell filtrate, or cell pellet. By obtaining the recombinant polypeptides so produced, a composition that includes the recombinant polypeptides can include bacterial cells, bacterial spores, and parasporal inclusion bodies and can be formulated for various uses, including as agricultural insect inhibitory spray products or as insect inhibitory formulations in diet bioassays.

In one embodiment, to reduce the likelihood of resistance development, an insect inhibitory composition comprising TIC7040, TIC7040HT, TIC7042, TIC7381, TIC7382, TIC7383, TIC7386, TIC7388, TIC7389, variant, truncation variant, chimera or related family member can further comprise at least one additional polypeptide known to those of ordinary skill in the art that exhibits insect inhibitory activity against the same Lepidopteran or Coleopteran insect species, but which is different from the TIC7040, TIC7040HT, TIC7042, TIC7381, TIC7382, TIC7383, TIC7386, TIC7388, TIC7389, variant, truncation variant, chimera or related family member toxin protein. Possible additional polypeptides for such a composition include an insect inhibitory protein and an insect inhibitory dsRNA molecule. One example for the use of such ribonucleotide sequences to control insect pests is described in Baum, et al. (U.S. Patent Publication 2006/0021087 A1).

Such additional polypeptide for the control of Lepidopteran pests may be selected from the group consisting of an insect inhibitory protein, such as, but not limited to, Cry1A (U.S. Pat. No. 5,880,275), Cry1Ab, Cry1Ac, Cry1A.105, Cry1Ae, Cry1B (U.S. patent publication Ser. No. 10/525,318), Cry1C (U.S. Pat. No. 6,033,874), Cry1D, Cry1Da and variants thereof, Cry1E, Cry1F, and Cry1A/F chimeras (U.S. Pat. Nos. 7,070,982; 6,962,705; and 6,713,063), Cry1G, Cry1H, Cry1I, Cry1J, Cry1K, Cry1L, Cry1-type chimeras such as, but not limited to, TIC836, TIC860, TIC867, TIC869, and TIC1100 (International Application Publication WO2016/061391 (A2)), TIC2160 (International Application Publication WO2016/061392(A2)), Cry2A, Cry2Ab (U.S. Pat. No. 7,064,249), Cry2Ae, Cry4B, Cry6, Cry7, Cry8, Cry9, Cry15, Cry43A, Cry43B, Cry51Aa1, ET66, TIC400, TIC800, TIC834, TIC1415, Vip3A, VIP3Ab, VIP3B, AXMI-001, AXMI-002, AXMI-030, AXMI-035, AND AXMI-045 (U.S. Patent Publication 2013-0117884

A1), AXMI-52, AXMI-58, AXMI-88, AXMI-97, AXMI-102, AXMI-112, AXMI-117, AXMI-100 (U.S. Patent Publication 2013-0310543 A1), AXMI-115, AXMI-113, AXMI-005 (U.S. Patent Publication 2013-0104259 A1), AXMI-134 (U.S. Patent Publication 2013-0167264 A1), AXMI-150 (U.S. Patent Publication 2010-0160231 A1), AXMI-184 (U.S. Patent Publication 2010-0004176 A1), AXMI-196, AXMI-204, AXMI-207, AXMI-209 (U.S. Patent Publication 2011-0030096 A1), AXMI-218, AXMI-220 (U.S. Patent Publication 2014-0245491 A1), AXMI-221z, AXMI-222z, AXMI-223z, AXMI-224z, AXMI-225z (U.S. Patent Publication 2014-0196175 A1), AXMI-238 (U.S. Patent Publication 2014-0033363 A1), AXMI-270 (U.S. Patent Publication 2014-0223598 A1), AXMI-345 (U.S. Patent Publication 2014-0373195 A1), AXMI-335 (International Application Publication WO2013/134523(A2)), DIG-3 (U.S. Patent Publication 2013-0219570 A1), DIG-5 (U.S. Patent Publication 2010-0317569 A1), DIG-11 (U.S. Patent Publication 2010-0319093 A1), AfIP-1A and derivatives thereof (U.S. Patent Publication 2014-0033361 A1), AfIP-1B and derivatives thereof (U.S. Patent Publication 2014-0033361 A1), PIP-1APIP-1B (U.S. Patent Publication 2014-0007292 A1), PSEEN3174 (U.S. Patent Publication 2014-0007292 A1), AECFG-592740 (U.S. Patent Publication 2014-0007292 A1), Pput_1063 (U.S. Patent Publication 2014-0007292 A1), DIG-657 (International Application Publication WO2015/195594(A2)), Pput_1064 (U.S. Patent Publication 2014-0007292 A1), GS-135 and derivatives thereof (U.S. Patent Publication 2012-0233726 A1), GS153 and derivatives thereof (U.S. Patent Publication 2012-0192310 A1), GS154 and derivatives thereof (U.S. Patent Publication 2012-0192310 A1), GS155 and derivatives thereof (U.S. Patent Publication 2012-0192310 A1), SEQ ID NO:2 and derivatives thereof as described in U.S. Patent Publication 2012-0167259 A1, SEQ ID NO:2 and derivatives thereof as described in U.S. Patent Publication 2012-0047606 A1, SEQ ID NO:2 and derivatives thereof as described in U.S. Patent Publication 2011-0154536 A1, SEQ ID NO:2 and derivatives thereof as described in U.S. Patent Publication 2011-0112013 A1, SEQ ID NO:2 and 4 and derivatives thereof as described in U.S. Patent Publication 2010-0192256 A1, SEQ ID NO:2 and derivatives thereof as described in U.S. Patent Publication 2010-0077507 A1, SEQ ID NO:2 and derivatives thereof as described in U.S. Patent Publication 2010-0077508 A1, SEQ ID NO:2 and derivatives thereof as described in U.S. Patent Publication 2009-0313721 A1, SEQ ID NO:2 or 4 and derivatives thereof as described in U.S. Patent Publication 2010-0269221 A1, SEQ ID NO:2 and derivatives thereof as described in U.S. Pat. No. 7,772,465 (B2), CF161_0085 and derivatives thereof as described in WO2014/008054 A2, Lepidopteran toxic proteins and their derivatives as described in US Patent Publications US2008-0172762 A1, US2011-0055968 A1, and US2012-0117690 A1; SEQ ID NO:2 and derivatives thereof as described in U.S. Pat. No. 7,510,878(B2), SEQ ID NO:2 and derivatives thereof as described in U.S. Pat. No. 7,812,129(B1), Cry71Aa1 and Cry72Aa1 (US Patent Publication US2016-0230187 A1), Axmi422 (US Patent Publication US2016-0201082 A1), Axmi440 (US Patent Publication US2016-0185830 A1), Axmi281 (US Patent Publication 2016-0177332 A1), BT-0044, BT-0051, BT-0068, BT-0128 and variants thereof (WO 2016-094159 A1), BT-009, BT-0012, BT-0013, BT-0023, BT0067 and variants thereof (WO 2016-094165 A1), Cry1JP578V, Cry1JPS1, Cry1 JPS1P578V (WO 2016-061208 A1); and the like.

Such additional polypeptide for the control of Coleopteran pests may be selected from the group consisting of an insect inhibitory protein, such as, but not limited to, Cry3Bb (U.S. Pat. No. 6,501,009), Cry1C variants, Cry3A variants, Cry3, Cry3B, Cry34/35, 5307, AXMI134 (U.S. Patent Publication 2013-0167264 A1) AXMI-184 (U.S. Patent Publication 2010-0004176 A1), AXMI-205 (U.S. Patent Publication 2014-0298538 A1), AXMI-207 (U.S. Patent Publication 2013-0303440 A1), AXMI-218, AXMI-220 (U.S. Patent Publication 20140245491A1), AXMI-221z, AXMI-223z (U.S. Patent Publication 2014-0196175 A1), AXMI-279 (U.S. Patent Publication 2014-0223599 A1), AXMI-R1 and variants thereof (U.S. Patent Publication 2010-0197592 A1, TIC407, TIC417, TIC431, TIC807, TIC853, TIC901, TIC1201, TIC3131, DIG-10 (U.S. Patent Publication 2010-0319092 A1), eHIPs (U.S. Patent Application Publication No. 2010/0017914), 1P3 and variants thereof (U.S. Patent Publication 2012-0210462 ω-Hexatoxin-Hv1a (U.S. Patent Application Publication 2014-0366227 A1), PHI-4 variants (U.S. Patent Application Publication 2016-0281105 A1), PIP-72 variants (WO 2016-144688 A1), PIP-45 variants, PIP-64 variants, PIP-74 variants, PIP-75 variants, and PIP-77 variants (WO 2016-144686 A1), DIG-305 (WO 2016109214 A1), PIP-47 variants (U.S. Patent Publication 2016-0186204 A1), DIG-17, DIG-90, DIG-79 (WO 2016-057123 A1), DIG-303 (WO 2016-070079 A1); and the like.

In other embodiments, such composition/formulation can further comprise at least one additional polypeptide that exhibits insect inhibitory activity to an insect that is not inhibited by an otherwise insect inhibitory protein of the present invention to expand the spectrum of insect inhibition obtained, e.g., an additional polypeptide that exhibits insect inhibitory activity to Hemipterans or Thysanopterans.

The possibility for insects to develop resistance to certain insecticides has been documented in the art. One insect resistance management strategy is to employ transgenic crops that express two distinct insect inhibitory agents that operate through different modes of action. Therefore, any insects with resistance to either one of the insect inhibitory agents can be controlled by the other insect inhibitory agent. Another insect resistance management strategy employs the use of plants that are not protected to the targeted Coleopteran or Lepidopteran pest species to provide a refuge for such unprotected plants. One particular example is described in U.S. Pat. No. 6,551,962, which is incorporated by reference in its entirety.

Other embodiments such as topically applied pesticidal chemistries that are designed for controlling pests that are also controlled by the proteins disclosed herein to be used with proteins in seed treatments, spray on, drip on, or wipe on formulations can be applied directly to the soil (a soil drench), applied to growing plants expressing the proteins disclosed herein, or formulated to be applied to seed containing one or more transgenes encoding one or more of the proteins disclosed. Such formulations for use in seed treatments can be applied with various stickers and tackifiers known in the art. Such formulations can contain pesticides that are synergistic in mode of action with the proteins disclosed, so that the formulation pesticides act through a different mode of action to control the same or similar pests that can be controlled by the proteins disclosed, or that such pesticides act to control pests within a broader host range or plant pest species that are not effectively controlled by the TIC7040, TIC7040HT, TIC7042, TIC7381, TIC7382, TIC7383, TIC7386, TIC7388, TIC7389, variant, truncation variant, chimera, or related family member pesticidal proteins.

The aforementioned composition/formulation can further comprise an agriculturally-acceptable carrier, such as a bait, a powder, dust, pellet, granule, spray, emulsion, a colloidal suspension, an aqueous solution, a *Bacillus* spore/crystal preparation, a seed treatment, a recombinant plant cell/plant tissue/seed/plant transformed to express one or more of the proteins, or bacterium transformed to express one or more of the proteins. Depending on the level of insect inhibitory or insecticidal inhibition inherent in the recombinant polypeptide and the level of formulation to be applied to a plant or diet assay, the composition/formulation can include various by weight amounts of the recombinant polypeptide, e.g. from 0.0001% to 0.001% to 0.01% to 1% to 99% by weight of the recombinant polypeptide.

EXAMPLES

In view of the foregoing, those of skill in the art should appreciate that changes can be made in the specific aspects which are disclosed and still obtain a like or similar result without departing from the spirit and scope of the invention. Thus, disclosed specific structural and functional details are not to be interpreted as limiting. It should be understood that the entire disclosure of each cited reference is incorporated within this disclosure.

Example 1

Discovery of TIC7040, TIC7040HT, TIC7042, TIC7381, TIC7382, TIC7383, TIC7386, TIC7388, TIC7389

This Example describes the discovery of the pesticidal proteins TIC7040, TIC7040HT, TIC7042, TIC7381, TIC7382, TIC7383, TIC7386, TIC7388, and TIC7389.

Sequences encoding novel *Brevibacillus laterosporus* (Bl) pesticidal proteins were identified, cloned, sequence confirmed and tested in insect bioassay. The pesticidal proteins TIC7040, TIC7040HT, TIC7042, TIC7381, TIC7382, TIC7383, TIC7386, TIC7388, and TIC7389 were isolated from the *Brevibacillus laterosporus* strains listed in Table 3, and represent novel pesticidal proteins belonging to the Cry43 family of toxins.

TABLE 3

Novel Cry43 pesticidal toxin proteins and corresponding *Brevibacillus laterosporus* strains.

| Toxin | DNA SEQ ID NO: | Protein SEQ ID NO: | *Brevibacillus laterosporus* strains | Length (a.a.) |
| --- | --- | --- | --- | --- |
| TIC7040 | 1 | 2 | DSC005019 | 1259 |
| TIC7040HT | 3 | 4 | DSC005019 | 1295 |
| TIC7042 | 11 | 12 | DSC005973 | 1266 |
| TIC7381 | 13 | 14 | DSC006713 | 1269 |
| TIC7382 | 15 | 16 | DSC007657 | 1246 |
| TIC7383 | 17 | 18 | DSC008106 | 1256 |
| TIC7386 | 29 | 30 | DSC007651 | 1279 |
| TIC7388 | 31 | 32 | DSC007962 | 1269 |
| TIC7389 | 33 | 34 | DSC006878 | 1319 |

Polymerase chain reaction (PCR) primers were designed based upon contigs derived from sequencing of each *Brevibacillus laterosporus* strains listed in Table 3. Amplicons of the full length coding sequence for each protein toxin was produced using total DNA isolated from each strain listed in Table 3. With respect to TIC7040, a coding sequence of 3,888 bp was produced through amplification and differed from the predicted coding sequence of 3,780 bp. The amplified coding sequence and corresponding amino acid sequence were designated "TIC7040HT" to distinguish it from the original predicted contig, TIC7040. Each of the amplicons, with the exception of TIC7040, were cloned using methods known in the art into *Bacillus thuringiensis* (Bt) expression vectors in operable linkage with a Bt expressible promoter.

Example 2

TIC7040HT, TIC7042, TIC7381, TIC7382, and TIC7383 Demonstrate Coleopteran and Lepidopteran Activity in Insect Bioassay This Example illustrates inhibitory activity exhibited by TIC7040HT, TIC7042, TIC7381, TIC7382, and TIC7383 proteins against various species of Coleoptera and Lepidoptera.

The pesticidal proteins TIC7040HT, TIC7042, TIC7381, TIC7382, and TIC7383 were expressed in Bt and assayed for toxicity against various species of Lepidoptera and Coleoptera. Preparations of each toxin were assayed against the Coleopteran species Western Corn Rootworm (*Diabrotica virgifera virgifera*, WCR), Cry3Bb-resistant Western Corn Rootworm (*Diabrotica virgifera virgifera*, WCRHP), Northern Corn Rootworm (*Diabrotica barberi*, NCR), Southern Corn Rootworm (*Diabrotica undecimpunctata howardii*, SCR), and Colorado potato beetle (*Leptinotarsa decemlineata*, CPB). Preparations of each toxin were also assayed against the Lepidopteran species Black Cutworm (*Agrotis ipsilon*, BCW), Corn Earworm (*Helicoverpa zea*, (CEW), also known as Soybean Podworm and Cotton Bollworm), Diamondback Moth (*Plutella xylostella*, DBM), European Corn Borer (*Ostrinia nubilalis*, ECB), Fall Armyworm (*Spodoptera frugiperda*, FAW), Southern Armyworm (*Spodoptera eridania*, SAW), Soybean Looper (*Pseudoplusia includes*, SBL), Southwestern Corn Borer (*Diatraea grandiosella*, SWCB), tobacco budworm (*Heliothis virescens*, TBW), and Velvetbean Caterpillar (*Anticarsia gemmatalis*, VBC). The toxin preparations were also assayed against the Hemipteran species Tarnished plant bug (*Lygus lineolaris*), Western tarnished plant bug (*Lygus hesperus*), and Neotropical Brown Stink Bug (*Euschistus heros*).

Transformed Bt expressing TIC7040HT, TIC7042, TIC7381, TIC7382, or TIC7383 were grown for twenty four (24) hours, and spores as well as solubilized proteins were added to the insect diet for assay. Mortality and stunting were evaluated by comparing the growth and development of insects on a diet with a culture from a Bt strain expressing TIC7040HT, TIC7042, TIC7381, TIC7382, or TIC7383 to insects on a diet with an untreated control culture. Activity was not observed for Hemipteran insect pests for TIC7040HT, TIC7042, TIC7381, TIC7382, or TIC7383. Activity was observed for Coleopteran and Lepidopteran insect pests. The bioassay activity with respect to stunting (S) and mortality (M) observed for each protein is presented in Tables 4 (Coleoptera) and 5 (Lepidoptera), wherein "+" indicates activity, an empty cell indicates no activity observed, and "NT" indicates the toxin was not assayed against that specific insect pest.

TABLE 4

Bioassay activity of TIC7040HT, TIC7042, TIC7381, TIC7382, and TIC7383 against Coleopteran insect pests.

| Toxin | WCR | | WCRHP | | NCR | | SCR | | CPB | |
|---|---|---|---|---|---|---|---|---|---|---|
| | S | M | S | M | S | M | S | M | S | M |
| TIC7040HT | + | + | + | + | + | + | + | | + | + |
| TIC7042 | + | + | + | + | + | + | + | | + | + |
| TIC7381 | + | + | + | + | + | + | + | + | + | + |
| TIC7382 | + | + | + | + | + | + | + | | + | + |
| TIC7383 | + | + | + | + | + | + | + | | + | + |
| TIC7389 | + | + | NT | NT | NT | NT | NT | NT | + | + |

TABLE 5

Bioassay activity of TIC7040HT, TIC7042, TIC7381, TIC7382, and TIC7383 against Lepidopteran insect pests.

| Toxin | BCW | | CEW | | DBM | | ECB | | FAW | | SAW | | SBL | | SWCB | | TBW | | VBC | |
|---|---|---|---|---|---|---|---|---|---|---|---|---|---|---|---|---|---|---|---|---|
| | S | M | S | M | S | M | S | M | S | M | S | M | S | M | S | M | S | M | S | M |
| TIC7040HT | | | | + | + | + | + | | + | | | | + | | + | | | | + | + |
| TIC7042 | + | | | + | + | + | + | | + | | | | + | | | | | | + | + |
| TIC7381 | | | | + | + | + | + | | + | + | | | + | + | + | | | | + | |
| TIC7382 | | | | | + | + | + | + | | | | | + | | + | + | | | + | |
| TIC7383 | | | | + | + | + | + | | | | | | | | | | | | + | |

As can be seen in Tables 4 and 5, the pesticidal proteins TIC7040HT, TIC7042, TIC7381, TIC7382, and TIC7383 demonstrated activity against many of the Coleopteran and Lepidopteran insect pest species. TIC7040HT demonstrated activity against the Coleopteran pests WCR, WCRHP, NCR, SCR, and CPB; and the Lepidopteran insect pests CEW, DBM, ECB, FAW, SBL, SWCB, and VBC. TIC7042 demonstrated activity against the Coleopteran pests WCR, WCRHP, NCR, SCR, and CPB; and the Lepidopteran insect pests BCW, CEW, DBM, ECB, FAW, SBL, and VBC. Mortality caused by TIC7042 against WCR was very high. TIC7381 demonstrated activity against the Coleopteran pests WCR, WCRHP, NCR, SCR, and CPB; and the Lepidopteran insect pests CEW, DBM, ECB, FAW, SBL, SWCB, and VBC. TIC7382 demonstrated activity against the Coleopteran pests WCR, WCRHP, NCR, SCR, and CPB; and the Lepidopteran insect pests DBM, ECB, SBL, SWCB, and VBC. TIC7383 demonstrated activity against the Coleopteran pests WCR, WCRHP, NCR, SCR, and CPB and; the Lepidopteran insect pests CEW, DBM, ECB, and VBC.

The pesticidal protein TIC7389 demonstrated activity against the Coleopteran pests, WCR and CPB. TIC7389 was also assayed against the Lepidopteran insect pest species Corn Earworm, Fall Armyworm, and Soybean Looper, as well as the Hemipteran species Tarnished plant bug and Western tarnished plant bug. Stunting was observed for SBL, but not the other two Lepidopteran species and the two Hemipteran insect pests.

The insect toxins TIC7040HT, TIC7042, TIC7381, TIC7382, TIC7383, and TIC7389 demonstrate activity against a variety of Coleopteran and Lepidopteran insect pest species. The insect toxin TIC7389 demonstrates toxicity to the Lepidopteran insect pest Soybean Looper.

Example 3

Tryptic Digested TIC7040HT and TIC7383, and Chymotryptic Digested TIC7040HT Demonstrate Activity Against Western Corn Rootworm This Example illustrates inhibitory activity exhibited by tryptic and chymotryptic digested TIC7040HT, and tryptic digested TIC7383 proteins against Western Corn Rootworm.

Protein samples of TIC7040HT were subjected to tryptic and chymotryptic digest in separate reactions. Likewise, TIC7383 was subjected to a tryptic digest. The tryptic and chymotryptic digests were performed using methods known in the art. The digested proteins were analyzed by mass spectrometry to determine the resulting protein fragments. The resulting tryptic and chymotryptic fragments of TIC7040HT, and the resulting tryptic fragment of TIC7383 are presented in Table 6.

The digested proteins were used in bioassay against Western Corn Rootworm. Table 6 shows the assay of activity for each digested protein preparation, and the full length TIC7040HT and TIC7383 proteins.

TABLE 6

Bioassay activity of TIC7040HT, tryptic and chymotryptic digested TIC7040HT, TIC7383, and tryptic digested TIC7383 against Western Corn Rootworm.

| Toxin | DNA SEQ ID NO: | Protein SEQ ID NO: | Amino Acid Position Relative to Full Length Protein | Stunting | Mortality |
|---|---|---|---|---|---|
| TIC7040HT | 3 | 4 | | + | + |
| TIC7040HT_Tryp | 70 | 71 | 43-624 | + | + |
| TIC7040HT_Chymo | 72 | 73 | 45-641 | + | + |
| TIC7383 | 17 | 18 | | + | + |
| TIC7383_Tryp | 74 | 75 | 55-668 | + | + |

As can be seen in Table 6, the tryptic and chymotryptic digested TIC7040HT and the tryptic digested TIC7383 proteins retained activity against Western Corn Rootworm.

Example 4

Truncations of TIC7040HT and TIC7383 Demonstrate Coleopteran Activity in Insect Bioassay This Example illustrates inhibitory activity exhibited by truncations of the TIC7040HT and TIC7383 proteins against various species of Coleoptera.

Coding sequences encoding truncations of TIC7040HT and TIC7383 were produced using methods known in the art and cloned into bacterial expression vectors to be expressed in Bt. The truncated proteins were provided in insect diets and assayed for activity against Coleopteran insect pests. The amino acid positions of the truncated TIC7040HT and TIC7383 toxins relative to the full length TIC7040HT and TIC7383 are shown in Table 7.

Transformed Bt expressing truncations of TIC7040HT and TIC7383 were grown for twenty four (24) hours and spores, as well as solubilized proteins, were added to insect diet for assay. Mortality and stunting were evaluated by comparing the growth and development of insects on a diet with a culture from the Bt strain expressing truncations of TIC7040HT or TIC7383 to insects on a diet with an untreated control culture.

The truncations of TIC7040HT and TIC7383 were assayed for toxicity against various species of Coleoptera. Preparations of each toxin were assayed against the Coleopteran species Western Corn Rootworm, Cry3Bb-resistant Western Corn Rootworm, and Colorado potato beetle.

Activity was observed for Coleopteran insect pests. The bioassay activity with respect to stunting (S) and mortality (M) observed for each protein is presented in Table 7, wherein "+" indicates activity, an empty cell indicates no activity observed, and "NT" indicates the toxin was not assayed against that specific insect pest. The activity of the full length TIC7040HT and TIC7383 is also provided for comparison to the truncated protein activity.

TABLE 7

Bioassay activity of truncations of TIC7040HT and TIC7383 against Coleopteran insect pests.

| | DNA SEQ ID | Protein SEQ ID | Amino Acid Positions Relative to Full Length | WCR | | WCRHP | | NCR | | SCR | | CPB | |
|---|---|---|---|---|---|---|---|---|---|---|---|---|---|
| Toxin | NO: | NO: | Protein | S | M | S | M | S | M | S | M | S | M |
| TIC7040HT | 3 | 4 | | + | + | + | + | + | + | + | | + | + |
| TIC7040HT_5 | 7 | 8 | 13-611 | + | + | | | NT | NT | NT | NT | + | + |
| TIC7040HT_6 | 9 | 10 | 13-671 | + | + | | | NT | NT | NT | NT | + | + |
| TIC7383 | 17 | 18 | | + | + | + | + | + | + | + | | + | + |
| TIC7383_2 | 19 | 20 | 12-1256 | + | + | | | NT | NT | NT | NT | + | + |
| TIC7383_3 | 21 | 22 | 1-659 | + | + | + | | NT | NT | NT | NT | + | + |
| TIC7383_4 | 23 | 24 | 1-679 | + | + | | | NT | NT | NT | NT | + | + |
| TIC7383_5 | 25 | 26 | 15-659 | + | + | | | NT | NT | NT | NT | + | + |
| TIC7383_6 | 27 | 28 | 15-679 | + | + | | | NT | NT | NT | NT | + | + |

As can be seen in Table 7, truncations of TIC7040HT and TIC7383 maintained activity against WCR and CPB.

Example 5

Design of Synthetic Coding Sequences Encoding TIC7040, TIC7040HT, TIC7042, TIC7381, TIC7382, TIC7383, and Truncation Variants of TIC7040HT, TIC7042, TIC7382, and TIC7383 for Expression in Plant Cells Synthetic or artificial coding sequences were constructed for use in expression of TIC7040, TIC7040HT, TIC7042, TIC7381, TIC7382, TIC7383, and truncation variants of TIC7040HT, TIC7042, TIC7382, and TIC7383, in plants. These synthetic coding sequences were cloned into a binary plant transformation vectors, and used to transform plant cells. The synthetic nucleic acid sequences were synthesized according to methods generally described in U.S. Pat. No. 5,500,365, avoiding certain inimical problem sequences such as ATTTA and A/T rich plant polyadenylation sequences while preserving the amino acid sequence of the native Bl protein. The synthetic coding sequences for the TIC7040, TIC7040HT, TIC7042, TIC7381, TIC7382, TIC7383, and truncation variants of TIC7040HT, TIC7042, TIC7382, and TIC7383 pesticidal proteins are presented Table 8.

TABLE 8

Synthetic coding sequences used for expression in plant cells encoding TIC7040, TIC7040HT, TIC7042, TIC7381, TIC7382, TIC7383, and truncation variants of TIC7040HT, TIC7042, TIC7382, and TIC7383.

| Description | DNA SEQ ID NO: | Protein SEQ ID NO: | Additional Alanine Residue after Initiating Methionine | N-terminal Truncation | C-terminal Truncation | Amino Acid Position Relative to Full Length Protein and Mutations |
|---|---|---|---|---|---|---|
| CR-BREla.TIC7040.nno_Mc:1 | 35 | 2 | No | No | No | |
| CR-BREla.TIC7040_10.nno_Mc:1 | 36 | 4 | No | No | No | |
| CR-BREla.TIC7040_10.nno_Mc:3 | 37 | 4 | No | No | No | |
| CR-BREla.TIC7040_10.nno_Mc:4 | 38 | 4 | No | No | No | |
| CR-BREla.TIC7040_10.nno_Mc:5 | 39 | 4 | No | No | No | |
| CR-BREla.TIC7040_10.nno_Mc:6 | 40 | 4 | No | No | No | |
| CR-BREla.TIC7040_10.nno_Mc:7 | 41 | 4 | No | No | No | |
| CR-BREla.TIC7040_1.nno_Mc:1 | 42 | 43 | No | Yes | Yes | 15-651 |
| CR-BREla.TIC7040_2.nno_Mc:1 | 44 | 10 | No | Yes | Yes | 13-671 |
| CR-BREla.TIC7040_11.nno_Mc:1 | 45 | 46 | No | Yes | Yes | 14-671 |
| CR-BREla.TIC7040_12.nno_Mc:2 | 47 | 48 | No | No | Yes | 1-660 |
| CR-BREla.TIC7040_13.nno_Mc:1 | 49 | 50 | No | No | Yes | 1-627 |
| CR-BREla.TIC7040_14.nno_Mc:1 | 76 | 77 | Yes | Yes | Yes | 52-660 |
| CR-BREla.TIC7042.nno_Mc:1 | 51 | 12 | No | No | No | |
| CR-BREla.TIC7042_1.nno_Mc:1 | 52 | 53 | No | Yes | Yes | 11-646 |
| CR-BREla.TIC7042_2.nno_Mc:1 | 54 | 55 | No | Yes | Yes | 11-665 |
| CR-BREla.TIC7381_1.nno_Mc:1 | 56 | 57 | Yes | No | No | |
| CR-BREla.TIC7381_2.nno_Mc:1 | 78 | 79 | Yes | No | Yes | 1-658 |
| CR-BREla.TIC7381_3.nno_Mc:1 | 80 | 81 | Yes | Yes | Yes | 50-658 |
| CR-BREla.TIC7382_1.nno_Mc:1 | 58 | 59 | Yes | No | No | |
| CR-BREla.TIC7382_2.nno_Mc:1 | 60 | 61 | Yes | No | Yes | 1-659 |
| CR-BREla.TIC7382_3.nno_Mc:1 | 82 | 83 | Yes | Yes | Yes | 52-659 |
| CR-BREla.TIC7383_1.nno_Mc:1 | 62 | 63 | Yes | No | No | |
| CR-BREla.TIC7383_7.nno_Mc:1 | 64 | 65 | Yes | Yes | Yes | 54-668 |
| CR-BREla.TIC7383_8.nno_Mc:1 | 66 | 67 | Yes | No | Yes | 1-661 |
| CR-BREla.TIC7383_9.nno_Mc:1 | 68 | 69 | Yes | No | Yes | 1-668 |
| CR-BREla.TIC7383_19.nno_Mc:1 | 84 | 85 | No | Yes | Yes | 15-668 |
| CR-BREla.TIC7383_20.nno_Mc:1 | 86 | 87 | No | Yes | Yes | 15-661 |
| CR-BREla.TIC7383_21.nno_Mc:1 | 88 | 89 | Yes | Yes | Yes | 54-661 |
| CR-BREla.TIC7383_22.nno_Mc:1 | 90 | 91 | No | Yes | Yes | 54-668 |
| CR-BREla.TIC7383_23.nno_Mc:1 | 92 | 93 | No | Yes | Yes | 54-661 |
| CR-BREla.TIC7383_24.nno_Mc:2 | 94 | 95 | No | Yes | Yes | 73-661 |
| CR-BREla.TIC7383_25.nno_Mc:3 | 96 | 97 | No | Yes | Yes | 94-661 |
| CR-BREla.TIC7383_26.nno_Mc:1 | 98 | 99 | No | Yes | Yes | 114-661 |
| CR-BREla.TIC7383_27.nno_Mc:1 | 100 | 101 | Yes | Yes | Yes | 54-658 |
| CR-BREla.TIC7383_28.nno_Mc:1 | 102 | 103 | No | Yes | Yes | 15-658 |
| CR-BREla.TIC7383_29.nno_Mc:1 | 104 | 105 | Yes | No | Yes | 1-963 |
| CR-BREla.TIC7383_30.nno_Mc:1 | 106 | 107 | Yes | No | No | K964A; R966A; K968A |
| CR-BREla.TIC7383_31.nno_Mc:1 | 108 | 109 | Yes | No | Yes | 1-1065; K964A; R966A; K968A |
| CR-BREla.TIC7383_32.nno_Mc:1 | 110 | 111 | Yes | No | No | Deletion 964-969 |

Example 6

Expression Cassettes for Expression of TIC7040, TIC7040HT, TIC7042, TIC7381, TIC7382, TIC7383, and Truncation Variants of TIC7040HT, TIC7042, TIC7382, and TIC7383 in Plant Cells A variety of plant expression cassettes were designed with the sequences as set forth in Table 8. Such expression cassettes are useful for transient expression in plant protoplasts or transformation of plant cells. Typical expression cassettes are designed with respect to the eventual placement of the protein within the plant cell. For a plastid targeted protein, the synthetic TIC7040, TIC7040HT, TIC7042, TIC7381, TIC7382, TIC7383 or truncation variant of TIC7040HT, TIC7042, TIC7382, or TIC7383 pesticidal protein coding sequences are operably linked in frame with a chloroplast targeting signal peptide coding sequence. The resulting plant transformation vectors comprise a first transgene cassette for expression of the pesticidal protein which comprises a constitutive promoter, operably linked 5' to a leader, operably linked 5' to an intron (or optionally no intron), operably linked 5' to a synthetic coding sequence encoding a plastid targeted or untargeted TIC7040, TIC7040HT, TIC7042, TIC7381, TIC7382, TIC7383, or truncation variant of TIC7040HT, TIC7042, TIC7382, or TIC7383 protein, which is in turn operably linked 5' to a 3' UTR and, a second transgene cassette for the selection of transformed plant cells using glyphosate or antibiotic selection. All of the elements described above are arranged contiguously often with additional sequence provided for the construction of the expression cassette such as restriction endonuclease sites or ligation independent cloning sites.

Example 7

TIC7382 Provides Efficacious Resistance to Western Corn Rootworm when Expressed in Stably Transformed Corn Plants This Example illustrates the inhibitory activity exhibited by truncations of TIC7382 against Coleoptera, such as Western Corn Rootworm, when expressed in plants and provided as a diet to the respective insect pest.

Binary plant transformation vectors comprising transgene cassettes designed to express untargeted TIC7382 (CR-BRE1a.TIC7382_1.nno_Mc:1) and the truncation variants CR-BRE1a.TIC7382_2.nno_Mc:1 and CR-BRE1a.TIC7382_3.nno_Mc:1 were cloned using methods known in the art. The plant transformation vectors comprised a first transgene cassette for expression of the TIC7382 pesticidal protein or one of the truncation variants which comprised a root preferred promoter, operably linked 5' to a leader, operably linked 5' to an intron, operably linked 5' to a synthetic coding sequence encoding TIC7382 or the truncation variants, each of which comprised an additional alanine residue immediately following the initiating methionine, which was in turn was operably linked 5' to a 3' UTR and, a second transgene cassette for the selection of transformed plant cells using glyphosate. The resulting vectors were used to stably transform corn plants using methods known in the art. Single T-DNA insertion events were selected and grown. Pesticidal activity was assayed against Western Corn Rootworm feeding on the roots of the stably transformed corn plants.

$R_0$ stably transformed plants were used to assay for Coleopteran resistance as well as generating $F_1$ progeny. Multiple single copy events were selected from each binary vector transformation. A portion of those events arising from each binary vector transformation were used in the Coleopteran assay, while another portion of events were used to generate $F_1$ progeny for further testing.

The $R_0$ assay plants were transplanted to eight inch pots. The plants were inoculated with eggs from Western Corn Rootworm. The eggs were incubated for approximately ten (10) days prior to inoculation to allow hatching to occur four (4) days after inoculation to ensure a sufficient number of larvae survive and are able to attack the corn roots. The transformed plants were inoculated at approximately V2 to V3 stage. The plants were grown after infestation for approximately twenty eight (28) days. The plants were removed from the pots with the roots being carefully washed to remove all soil. The damage to the roots was assessed using a damage rating scale of 1-5, as presented in Table 9. Comparison was also made to the negative control to assure the assay has been performed properly. Low root damage scores indicate resistance conferred by the TIC7382 protein or the truncation variants to WCR. An RDR score of 1.0 to 2.5 represents good efficacy, an RDR score of 2.6 to 3.5 represents medium efficacy, and an RDR score of 3.6 to 5.0 represents low efficacy.

TABLE 9

$R_0$ root damage rating scores.

| Root Damage Score | Description |
| --- | --- |
| 1 | No visible feeding |
| 2 | Some feeding; no pruning |
| 3 | Pruning of at least one root |

TABLE 9-continued $R_0$ root damage rating scores.

| Root Damage Score | Description |
| --- | --- |
| 4 | Entire node pruned |
| 5 | More than one node pruned |

For $F_1$ assay, eggs from Western Corn Rootworm were incubated for approximately ten (10) days to allow hatching within four (4) days after inoculation. The plants were inoculated at approximately V2 to V3 stage. Each pot was inoculated with about two thousand eggs. The plants were grown after infestation for approximately twenty eight (28) days. The plants were removed from the pots with the roots being carefully washed to remove all soil. The damage to the roots were assessed using a damage rating scale of 0-3, as presented in Table 10. Comparison was made to the negative control to assure the assay was performed properly. Low root damage scores indicate resistance conferred TIC7382, or the truncation to WCR. An RDR at $F_1$ of 0.0 to 0.75 represents good efficacy, an RDR of 0.76 to 1.5 represents medium efficacy, and an RDR of 1.6 to 3.0 represents low efficacy.

TABLE 10

$F_1$ root damage rating scores.

| Root Damage Score | Description |
| --- | --- |
| 0 | No visible feeding |
| 0.01-0.09 | Feeding scars and tracks |
| 0.1-0.9 | Root pruning, but less than a full node |
| 1.0-1.9 | At least a full node (or equivalent) destroyed to within 1.5 inches of plant |
| 2.0-2.9 | Two or more nodes gone |
| 3 | Three or more nodes gone |

Table 11 shows the average Root Damage Rating (RDR) assayed for the TIC7382 protein and truncation variants.

TABLE 11

Average Root Damage Rating (RDR) of transgenic corn plants expressing TIC7382 or truncation variants.

| Description | Coding Sequence SEQ ID NO: | Protein SEQ ID NO: | Amino Acid Position Relative to Full Length Protein | Average $R_0$ RDR | Average $F_1$ RDR |
| --- | --- | --- | --- | --- | --- |
| CR-BRE1a.TIC7382_1.nno_Mc:1 | 58 | 59 | | 3.7 | 2.4 |
| CR-BRE1a.TIC7382_2.nno_Mc:1 | 60 | 61 | 1-658 | 3.3 | 1.1 |
| CR-BRE1a.TIC7382_3.nno_Mc:1 | 82 | 83 | 50-658 | 1.6 | 1.0 |

As can be seen in Table 11, a C-terminal truncation of the TIC7382 protein giving rise to the truncation variant, CR-BRE1a.TIC7382_2.nno_Mc:1, improved efficacy relative to the Root Damage Ratings of CR-BRE1a.TIC7382_1.nno_Mc:1. Truncation of the TIC7382 protein at both the N-terminus and C-terminus giving rise to the truncation variant, CR-BRE1a.TIC7382_3.nno_Mc:1, resulted in less damage to the corn roots and further improved efficacy as demonstrated by a lower R₀ Root Damage Rating when compared to the Root Damage Ratings of CR-BRE1a.TIC7382_1.nno_Mc:1 and CR-BRE1a.TIC7382_2.nno_Mc: 1.

Example 8

Assay of Activity of TIC7040, TIC7040HT, TIC7042, TIC7381, TIC7382, TIC7383, and Truncation Variants of TIC7040HT, TIC7042, TIC7382, or TIC7383 Against Coleopteran Corn Rootworm Pests when Expressed in Stably Transformed Corn Plants This Example illustrates the inhibitory activity of TIC7040, TIC7040HT, TIC7042, TIC7381, TIC7382, TIC7383, or truncation variants of TIC7040HT, TIC7042, TIC7382, or TIC7383 against different Coleopteran species that feed on corn roots.

Binary plant transformation vectors comprising transgene cassettes designed to express both plastid targeted and untargeted TIC7040, TIC7040HT, TIC7042, TIC7381, TIC7382, TIC7383, or truncation variants of TIC7040HT, TIC7042, TIC7382, or TIC7383 are cloned using methods known in the art and comprise the sequences as shown in Table 8. The resulting vectors are used to stably transform corn plants using methods known in the art. Single T-DNA insertion events are selected and grown. Pesticidal activity is assayed against the Coleopteran pests Western Corn Rootworm (*Diabrotica virgifera virgifera*, WCR), Northern Corn Rootworm (*Diabrotica barberi*, NCR), Mexican Corn Rootworm (*Diabrotica virgifera zeae*, MCR), Brazilian Corn Rootworm (*Diabrotica balteata*, BZR), Southern Corn Rootworm (*Diabrotica undecimpunctata howardii*, SCR), Colorado potato beetle (*Leptinotarsa decemlineata*, CPB), or a Brazilian Corn Rootworm complex (BCR, consisting of *Diabrotica viridula* and *Diabrotica speciosa*) feeding on the roots of the stably transformed corn plants.

R₀ stably transformed plants are used to assay for Coleopteran resistance as well as generating F₁ progeny. Multiple single copy events are selected from each binary vector transformation. A portion of the events arising from each binary vector transformation are used in the R₀ Coleopteran assay, while another portion of events are used to generate F₁ progeny for further testing.

The R₀ assay plants are transplanted to eight inch pots. The plants are inoculated with eggs from Western Corn Rootworm, Northern Corn Rootworm, or Southern Corn Rootworm. The eggs are incubated for approximately ten (10) days prior to inoculation to allow hatching to occur four (4) days after inoculation to ensure a sufficient number of larvae survive and are able to attack the corn roots. The transformed plants are inoculated at approximately V2 to V3 stage. The plants are grown after infestation for approximately twenty eight (28) days. The plants are removed from the pots with the roots being carefully washed to remove all soil. The damage to the roots is assessed using a damage rating scale of 1-5, as presented in Table 9 in Example 5. Comparison is also made to the negative controls to assure the assay has been performed properly. Multiple R₀ events for each binary vector transformation are used in the Coleopteran assay. Low root damage scores indicate resistance conferred by TIC7040, TIC7040HT, TIC7042, TIC7381, TIC7382, TIC7383, or truncation variants of TIC7040HT, TIC7042, TIC7382, or TIC7383 to the tested Coleopteran pest.

A portion of the R₀ stably transformed events arising from each binary vector transformation are used to produce F₁ progeny. The R₀ stably transformed plants are allowed to self-fertilize, producing F₁ progeny. The F₁ seed is planted. Heterozygous plants are identified through molecular methods known in the art and used for assay against Coleopteran pests, as well as ELISA expression measurements of toxin protein. A portion of the heterozygous F₁ progeny from each event are used for insect assay, while another portion is used to measure toxin protein expression.

Eggs from Western Corn Rootworm, Northern Corn Rootworm, or Southern Corn Rootworm are incubated for approximately ten (10) days to allow hatching within four (4) days after inoculation. For WCR, each pot is inoculated with about two thousand eggs. For NCR, less eggs may be used due to the lower availability of eggs from this species. The plants are inoculated at approximately V2 to V3 stage. The plants are grown after infestation for approximately twenty eight (28) days. The plants are removed from the pots with the roots being carefully washed to remove all soil. The damage to the roots are assessed using a damage rating scale of 0-3, as presented in Table 10 in Example 5. Comparison is made to the negative control to assure the assay has been performed properly. Low root damage scores indicate resistance conferred by TIC7040, TIC7040HT, TIC7042, TIC7381, TIC7382, TIC7383, or truncation variants of TIC7040HT, TIC7042, TIC7382, or TIC7383 protein to the Coleopteran pest.

Example 9

Assay of Activity of TIC7040, TIC7040HT, TIC7042, TIC7381, TIC7382, TIC7383, or Truncation Variants of TIC7040HT, TIC7042, TIC7382, or TIC7383 Against Lepidopteran Pests when Expressed in Stably Transformed Corn, Soybean, or Cotton Plants This Example illustrates the assay of activity against various Lepidopteran pest species fed tissue from stably transformed corn, soybean or cotton plants expressing TIC7040, TIC7040HT, TIC7042, TIC7381, TIC7382, TIC7383, or truncation variants of TIC7040HT, TIC7042, TIC7382, or TIC7383.

Binary plant transformation vectors comprising transgene cassettes designed to express both plastid targeted and untargeted TIC7040, TIC7040HT, TIC7042, TIC7381, TIC7382, TIC7383, or truncation variants of TIC7040HT, TIC7042, TIC7382, or TIC7383 are cloned using methods known in the art and comprise the coding sequences as presented in Table 8.

Corn, soybean, or cotton is transformed with the binary transformation vectors described above using an *Agrobacterium*-mediated transformation method. The transformed cells are induced to form plants by methods known in the art. Bioassays using plant leaf disks are performed analogous to those described in U.S. Pat. No. 8,344,207. A non-transformed corn, soybean, or cotton plant is used to obtain tissue to be used as a negative control. Multiple transformation events from each binary vector are assessed against Lepidopteran pests such as, but not limited to, Black Cutworm, Corn Earworm, Diamondback Moth, European Corn Borer, Fall Armyworm, Southern Armyworm, Soybean Looper, Southwestern Corn Borer, Tobacco budworm, and Velvetbean Caterpillar. Those insects demonstrating stunting and/or mortality in the insect bioassay are determined to be susceptible to the effects of the tested TIC7040, TIC7040HT, TIC7042, TIC7381, TIC7382, TIC7383, or truncation variant of TIC7040HT, TIC7042, TIC7382, or TIC7383 insect toxin pesticidal protein.

Example 10

Assay of Activity of TIC7040, TIC7040HT, TIC7042, TIC7381, TIC7382, TIC7383, or Truncation Variants of TIC7040HT, TIC7042, TIC7382, or TIC7383 Against Flea Beetle Pests when Expressed in Stably Transformed Canola Plants This Example illustrates the assay of activity against various species of Flea Beetle when allowed to feed on whole transgenic canola plants or tissues derived from transgenic canola plants expressing TIC7040, TIC7040HT, TIC7042, TIC7381, TIC7382, TIC7383, or truncation variants of TIC7040HT, TIC7042, TIC7382, or TIC7383.

Binary plant transformation vectors comprising transgene cassettes designed to express both plastid targeted and untargeted TIC7040, TIC7040HT, TIC7042, TIC7381, TIC7382, TIC7383, or truncation variants of TIC7040HT, TIC7042, TIC7382, or TIC7383 are cloned using methods known in the art and comprise the coding sequences as presented in Table 8.

The resulting binary transformation vectors are used to stably transform canola plant cells using methods known in the art. The transformed cells are induced to form plants. Bioassays using plant leaf disks are performed analogous to those described in U.S. Pat. No. 8,344,207 using field collected Flea Beetles. A non-transformed canola plant is used to obtain tissue to be used as a negative control. Multiple transformation events from each binary vector are assessed against Coleopteran Flea Beetle pests such as, but not limited to, Crucifer Flea Beetle (*Phyllotreta cruciferae*), Striped Flea Beetle (*Phyllotreta striolata*), and Western Black Flea Beetle (*Phyllotreta pusilla*). Flea Beetle mortality is determined each day as the Beetles continue to feed. Leaf discs are changed every two (2) to three (3) days over a twelve (12) day period to assure fresh material is available to the Flea Beetles for feeding, and to reduce any impact of protein degradation in the sample.

Alternatively, transformed canola plants can be planted in a field where Flea Beetle infestations are present. The plants can be housed in a tent to prevent those Flea Beetles that emerge from the soil from escaping the experimental plots. Damage ratings of the canola leaves can be taken to determine which plants experienced lesser damage and demonstrated resistance to the Flea Beetles.

Example 11

Truncation of TIC7383 Improves Efficacy Against Corn Rootworm in Stably Transformed Corn Plants This Example illustrates the improvement of efficacy of the TIC7383 through truncations at the N-terminus, the C-terminus, or both termini.

Binary plant transformation vectors comprising transgene cassettes designed to express untargeted TIC7383 and truncation variants were cloned using method known in the art. The plant transformation vectors comprised a first transgene cassette for expression of the TIC7383 pesticidal protein or the truncation variants which comprised a root preferred promoter, operably linked 5' to a leader, operably linked 5' to an intron, operably linked 5' to a synthetic coding sequence encoding TIC7383 or the truncation variants, some of which comprised an additional alanine residue immediately following the initiating methionine, which was in turn was operably linked 5' to a 3' UTR and, a second transgene cassette for the selection of transformed plant cells using glyphosate. The resulting vectors were used to stably transform corn plants using methods known in the art. Single T-DNA insertion events were selected and grown. Pesticidal activity was assayed against Western Corn Rootworm feeding on the roots of the stably transformed corn plants.

$R_0$ stably transformed plants were used to assay for resistance to Western Corn Rootworm as well as generating $F_1$ progeny. Multiple single copy events were selected from each binary vector transformation. A portion of those events arising from each binary vector transformation were used in the Coleopteran assay, while another portion of events were used to generate $F_1$ progeny for further testing. $R_0$ and $F_1$ Root Damage Rating scores were determined using the Root Damage Rating scores as presented in Tables 9 and 10, respectively, presented in Example 7. Table 12 shows the average Root Damage Rating scores obtained from the $R_0$ and $F_1$ stably transformed corn plants expressing TIC7383 and truncation variants. Protein expression levels of TIC7383 and the corresponding truncation variants are also shown in Table 12 and are expressed as parts per million (ppm).

As can be seen in Table 12, truncations at the N-terminus, C-terminus, or both termini improved efficacy in some of the truncation variants as demonstrated by lower average Root Damage Rating scores relative to the full length TIC7383 protein (CR-BRE1a.TIC7383_1.nno_Mc:1). Truncations of the TIC7383 toxin also improved expression within the plant in most instances as well.

TABLE 12

Average Root Damage Rating (RDR) scores of stably transformed corn plants expressing TIC7383 and truncation variants.

| Description | Additional Alanine Residue after Initiating Methionine | Amino Acid Position Relative to CR-BREla. TIC7383_1. nno_Mc:1 | Protein Expression (ppm) | Average $R_0$ RDR | Average $F_1$ RDR |
|---|---|---|---|---|---|
| CR-BREla. TIC7383_ 1.nno_Mc:1 | Yes | | 11.9 | 3.8 | 2.2 |
| CR-BREla. TIC7383_ 7.nno_Mc:1 | Yes | 54-668 | 421.3 | 2.9 | 1.6 |
| CR-BREla. TIC7383_ 8.nno_Mc:1 | Yes | 1-661 | 289.2 | 2.4 | |
| CR-BREla. TIC7383_ 9.nno_Mc:1 | Yes | 1-668 | 317.2 | 3.3 | |
| CR-BREla. TIC7383_ 19.nno_Mc:1 | No | 15-668 | 23.7 | 3.3 | |
| CR-BREla. TIC7383_ 20.nno_Mc:1 | No | 15-661 | 29.1 | 3.9 | |
| CR-BREla. TIC7383_ 21.nno_Mc:1 | Yes | 54-661 | 617.4 | 2.7 | |
| CR-BREla. TIC7383_ 22.nno_Mc:1 | No | 54-668 | 451.3 | 2.6 | |

TABLE 12-continued Average Root Damage Rating (RDR) scores of stably transformed corn plants expressing TIC7383 and truncation variants.

| Description | Additional Alanine Residue after Initiating Methionine | Amino Acid Position Relative to CR-BREla. TIC7383_1. nno_Mc:1 | Protein Expression (ppm) | Average $R_0$ RDR | Average $F_1$ RDR |
|---|---|---|---|---|---|
| CR-BREla. TIC7383_ 23.nno_Mc:1 | No | 54-661 | 343.1 | | 2.8 |
| CR-BREla. TIC7383_ 24.nno_Mc:2 | No | 73-661 | 356.5 | | 2.9 |
| CR-BREla. TIC7383_ 26.nno_Mc:1 | No | 114-661 | 8.5 | | 3.9 |
| CR-BREla. TIC7383_ 27.nno_Mc:1 | Yes | 54-658 | 356.2 | | 2.9 |
| CR-BREla. TIC7383_ 28.nno_Mc:1 | No | 15-658 | 25.4 | | 3.7 |

Example 12

Assay of Activity of Chimeras of TIC7381, TIC7382, TIC7383 and TIC7042 Against Western Corn Rootworm in Stably Transformed Corn Plants This Example illustrates the design of chimeras of TIC7381, TIC7382, TIC7383, and TIC7042 and the assay of activity against Western Corn Rootworm (WCR) in stably transformed corn plants expressing the chimeras.

Chimeras of TIC7381, TIC7382, TIC7383, and TIC7042 were designed wherein domains one and two (D1D2) of one toxin were combined with the third domain (D3) of another toxin. Table 13 below shows the composition of each chimera.

TABLE 13

Composition of the TIC7381, TIC7382, TIC7383, and TIC7042 chimeras.

| Description | Nucleotide SEQ ID NO: | Protein SEQ ID NO: | D1D2 | D3 |
|---|---|---|---|---|
| GOI-TIC10743.nno_Mc:1 | 112 | 113 | TIC7383 | TIC7042 |
| GOI-TIC10744.nno_Mc:1 | 114 | 115 | TIC7383 | TIC7381 |
| GOI-TIC10745.nno_Mc:1 | 116 | 117 | TIC7383 | TIC7382 |
| GOI-TIC10746.nno_Mc:1 | 118 | 119 | TIC7382 | TIC7383 |
| GOI-TIC10747.nno_Mc:1 | 120 | 121 | TIC7381 | TIC7383 |
| GOI-TIC10748.nno_Mc:1 | 122 | 123 | TIC7042 | TIC7383 |

Binary plant transformation vectors comprising transgene cassettes designed to express untargeted chimeras of TIC7381, TIC7382, TIC7383, and TIC7042 were cloned using methods known in the art. The plant transformation vectors comprised a first transgene cassette for expression of the chimeric toxin pesticidal protein which comprised a root preferred promoter, operably linked 5' to a leader, operably linked 5' to an intron, operably linked 5' to a synthetic coding sequence encoding the chimeras of TIC7381, TIC7382, TIC7383, and TIC7042, which comprised an additional alanine residue immediately following the initiating methionine, which was in turn was operably linked 5' to a 3' UTR and, a second transgene cassette for the selection of transformed plant cells using glyphosate. The resulting vectors were used to stably transform corn plants using methods known in the art. Single T-DNA insertion events were selected and grown. Pesticidal activity was assayed against Western Corn Rootworm feeding on the roots of the stably transformed corn plants.

$R_0$ stably transformed plants were used to assay for resistance to Western Corn Rootworm as well as generating $F_1$ progeny. Multiple single copy events were selected from each binary vector transformation. A portion of those events arising from each binary vector transformation were used in the Coleopteran assay, while another portion of events were used to generate $F_1$ progeny for further testing. $R_0$ and $F_1$ Root Damage Rating scores were determined using the Root Damage Rating scores as presented in Tables 9 and 10, respectively, presented in Example 7. Table 14 shows the average Root Damage Rating scores obtained from the $R_0$ and $F_1$ stably transformed corn plants expressing the chimeras of TIC7381, TIC7382, TIC7383, and TIC7042 or truncation variants, wherein "NT" indicates not tested. Comparison is made to a TIC7382 variant truncated at the N-terminus and C-terminus protoxin domain (CR-BREla.TIC7382_3.nno_Mc:1) and a TIC7383 variant truncated at the N-terminus and C-terminus protoxin domain (CR-BREla.TIC7383_7.nno_Mc:1).

TABLE 14

Average Root Damage Rating (RDR) scores of stably transformed corn plants expressing chimeras of TIC7381, TIC7382, TIC7383, and TIC7042 against Western Corn Rootworm.

| Description | Average $R_0$ RDR | Average $F_1$ RDR |
|---|---|---|
| Negative Control | | 2.8 |
| GOI-TIC10743.nno_Mc:1 | 3.4 | 2 |
| GOI-TIC10744.nno_Mc:1 | 3.3 | 2.3 |
| GOI-TIC10745.nno_Mc:1 | 3.8 | 2.6 |
| GOI-TIC10746.nno_Mc:1 | 1.3 | 0.4 |
| GOI-TIC10747.nno_Mc:1 | NT | NT |
| GOI-TIC10748.nno_Mc:1 | 3.3 | 2.7 |
| CR-BREla.TIC7382_3.nno_Mc:1 | 1.6 | 1.0 |
| CR-BREla.TIC7383_7.nno_Mc:1 | 3 | 1.5 |

As can be seen in Table 14, the chimeric toxin GOI-TIC10746.nno_Mc:1 comprised of domains one and two of TIC7382 and domain three of TIC7383 gave better efficacy at $R_0$ and $F_1$ relative to the negative control, CR-BREla.TIC7382_3.nno_Mc:1, and CR-BREla.TIC7383_7.nno_Mc:1. Four $F_1$ events expressing GOI-TIC10746.nno_Mc:1 were included in the assay. Root Damage Ratings scores ranged from 0.11 to 0.79 with (RDR: 0.11, 0.20, 0.30, and 0.79). The one GOI-TIC10746.nno_Mc:1 expressing event with an RDR of 0.11 was equal to a commercial control. In addition to the data presented above, protein isolated from bacteria expressing the chimeric toxin GOI-TIC10746.nno_Mc:1 also demonstrated activity against Northern Corn Rootworm when presented in a diet bioassay.

Example 13

Assay of Activity of Chimeras of TIC7382 and TIC7383 Corn Rootworm in Stably Transformed Corn Plants This Example illustrates the design of chimeras of TIC7382 and TIC7383 and the assay of activity against Western Corn Rootworm (WCR) in stably transformed corn plants expressing the chimeras.

Synthetic coding sequences encoding chimeric toxins comprised of domains one and two of TIC7382 and domain three of TIC7383 designed for expression in plants are cloned using methods known in the art. The chimeric toxin, TIC10746NTermExt1 (SEQ ID NO:125, encoded by SEQ ID NO:124) comprises the N-terminal extension of TIC7382. The chimeric toxin, TIC10746NTermExt2 (SEQ ID NO:127, encoded by SEQ ID NO:126) comprises the N-terminal extension of TIC7383. The synthetic coding sequences are cloned in binary plant transformation vectors similar to those described in Example 12 and used to transform corn plants. Root assays are performed as previously described in Example 8 for $R_0$ and $F_1$ plants after infestation of such corn rootworm species as Western Corn Rootworm (*Diabrotica virgifera virgifera*, WCR), Northern Corn Rootworm (*Diabrotica barberi*, NCR), Mexican Corn Rootworm (*Diabrotica virgifera zeae*, MCR), Brazilian Corn Rootworm (*Diabrotica balteata*, BZR), Southern Corn Rootworm (*Diabrotica undecimpunctata howardii*, SCR), Colorado potato beetle (*Leptinotarsa decemlineata*, CPB), or a Brazilian Corn Rootworm complex (BCR, consisting of *Diabrotica viridula* and *Diabrotica speciosa*). Average low Root Damage Rating (RDR) scores of $R_0$ and $F_1$ plants relative to non-transformed corn plant controls are demonstrative of resistant to the corn rootworm species conferred by expression of the chimeric toxins.

All of the compositions disclosed and claimed herein can be made and executed without undue experimentation in light of the present disclosure. While the compositions of this invention have been described in terms of the foregoing illustrative embodiments, it will be apparent to those of skill in the art that variations, changes, modifications, and alterations may be applied to the compositions described herein, without departing from the true concept, spirit, and scope of the invention. More specifically, it will be apparent that certain agents that are both chemically and physiologically related may be substituted for the agents described herein while the same or similar results would be achieved. All such similar substitutes and modifications apparent to those skilled in the art are deemed to be within the spirit, scope, and concept of the invention as defined by the appended claims.

All publications and published patent documents cited in the specification are incorporated herein by reference to the same extent as if each individual publication or patent application was specifically and individually indicated to be incorporated by reference.

SEQUENCE LISTING (127 sequences)

SEQ ID NO: 1 - DNA, 3780 bp, Brevibacillus laterosporus
  misc_feature (1)..(3780): A nucleic acid encoding a TIC7040 pesticidal protein sequence obtained from Brevibacillus laterosporus species DSC005019.
atgaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaatacacgaccgattatgatatagatcaagctgcaaacttggtagaatgtgtatctgatgaatgtgcaaatgctaaaatgatcctattagatgaagtaaaatatgcgaaacaactcagcgaagcccgcaatctacttctgaatggtaattttgaataccaagatagagatggggagaatccatggaaaacaagtccaaatgttaccatccaggaaaataaccccatttttaaaggccgttatctcagtatgtcgggtgcaaactatatcgaggcaacaaatgatactttccccacttatgcataccaaaaaatagatgaagcaaaattaaaaccctatacccgttataaagttcgagggtttgttggaaatagtaaagatttagagttgttgattaaacggtatgatgaagaagtggatgcgattttaaatgtaccaaatgatataccacatgctccgacacctttctgcggtggatttgatcgatgcaagccacattcttatattcctatgaatccagaatgtcaccatgatgtaataaataacattgaaatatcctctccttgccaacacaataagatgttggataacgctgatatatcttctcgccatagtgaattaggtaaaaaacgtggaatttgtcatgaatctcatcattttgaattccatattgatacaggaaaaatcgatttgaacgaaaatttgggaatttgggttatatttaaaatatgttccacagatggttacgcaacattagataatttggaagttattgaagagggtcctttaggagccgaatcattagaacgtgtgaaaagaagagaaaagaaatggaaacatcacatggaacacaagtgttcagaaactaaacttgcatatcatgctgcaaaacaagcgctggtggggttattcacaaacactaaatatgatagattaaagttcgaaacaaccatatccaatattctttttgctgattatctcgtgcagtcaattccgtatgtatataataaatggttaccagatgttccaggtatgaattacgatatctatacagaattaaaaaatctgtttacgggagctttcaatttatatgatcagcgaaatattataaaaaatggagactttaatcgcgggctcatgcattggcatgcgacacctcatgcaagagtagagcaaatagataataggtctgtgctggtgcttccaaattatgctgccaatgtttcacaagaggtttgtttagaacacaatcgtggttatgtattacgtgtaacggcgaaaaaagaaggccctggaattggatatgttacattcagtgattgtgcaaataatatagaaaaactgacatttacttcttgcgattatggtacaaacgaagtgacatatgagcaatctaattatcatacagacggagtaccgtacgaacaatctaattatcctacagacggagtaccgtacgaacaacatggttgtcatacagacggagtaccgtacgaacaatctagttatcctacagacggagtaccgtacgaacaacatggttgtcgtacagacggagtactatacaaacaacatggttgtcgtacagacagatcaagagatgaacaacttgattatgtgacaaaaacgattgatgtattccctgatactgataaagtacgtatcgacattggagaaaccgaaggtacctttaaagtagaaagtgtggaactgatttttatggaagagtaa

SEQ ID NO: 2 - protein, 1259 aa, Brevibacillus laterosporus
  MISC_FEATURE (1)..(1259): The amino acid sequence of the TIC7040 protein.
MNQNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIGGSLSEYETKHQLEKARKAVNDLFTNESKNVLKKYTTDYDIDQAANLVECVSDECANAKMILLDEVKYAKQLSEARNLLLNGNFEYQDRDGENPWKTSPNVTIQENNPIFKGRYLSMSGANYIEATNDTFPTYAYQKIDEAKLKPYTRYKVRGFVGNSKDLELLIKRYDEEVDAILNVPNDIPHAPTPFCGGFDRCKPHSYIPMNPECHHDVINNIEISSPCQHNKMLDNADISSRHSELGKKRGICHESHHFEFHIDTGKIDLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVTYEQSNYHTDGVPYEQSNYPTDGVPYEQHGCHTDGVPYEQSSYPTDGVPYEQHGCRTDGVLYKQHGCRTDRSRDEQLDYVTKTIDVFPDTDKVRIDIGETEGTFKVESVELIFMEE

SEQ ID NO: 3 - DNA, 3888 bp, Brevibacillus laterosporus
  misc_feature (1)..(3888): A nucleic acid encoding a TIC7040HT pesticidal protein sequence obtained from Brevibacillus laterosporus species DSC00519.
atgaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaatacacgaccgattatgatatagatcaagctgcaaacttggtagaatgtgtatctgatgaatgtgcaaatgctaaaatgatcctattagatgaagtaaaatatgcgaaacaactcagcgaagcccgcaatctacttctgaatggtaattttgaataccaagatagagatggggagaatccatggaaaacaagtccaaatgttaccatccaggaaaataaccccatttttaaaggccgttatctcagtatgtcgggtgcaaactatatcgaggcaacaaatgatactttccccacttatgcataccaaaaaatagatgaagcaaaattaaaaccctatacccgttataaagttcgagggtttgttggaaatagtaaagatttagagttgttgattaaacggtatgatgaagaagtggatgcgattttaaatgtaccaaatgatataccacatgctccgacacctttctgcggtggatttgatcgatgcaagccacattcttatattcctatgaatccagaatgtcaccatgatgtaataaataacattgaaatatcctctccttgccaacacaataagatgttggataacgctgatatatcttctcgccatagtgaattaggtaaaaaacgtggaatttgtcatgaatctcatcattttgaattccatattgatacaggaaaaatcgatttgaacgaaaatttgggaatttgggttatatttaaaatatgttccacagatggttacgcaacattagataatttggaagttattgaagagggtcctttaggagccgaatcattagaacgtgtgaaaagaagagaaaagaaatggaaacatcacatggaacacaagtgttcagaaactaaacttgcatatcatgctgcaaaacaagcgctggtggggttattcacaaacactaaatatgatagattaaagttcgaaacaaccatatccaatattctttttgctgattatctcgtgcagtcaattccgtatgtatataataaatggttaccagatgttccaggtatgaattacgatatctatacagaattaaaaaatctgtttacgggagctttcaatttatatgatcagcgaaatattataaaaaatggagactttaatcgcgggctcatgcattggcatgcgacacctcatgcaagagtagagcaaatagataataggtctgtgctggtgcttccaaattatgctgccaatgtttcacaagaggtttgtttagaacacaatcgtggttatgtattacgtgtaacggcgaaaaaagaaggccctggaattggatatgttacattcagtgattgtgcaaataatatagaaaaactgacatttacttcttgcgattatggtacaaacgaagtgacatatgagcaatctaattatcatacagacggagtaccgtacgaacaatctaattatcctacagacggagtaccgtacgaacaacatggttgtcatacagacggagtaccgtacgaacaatctaattatcctacagacggagtaccgtacgaacaacatggttgtcatacagacggagttccgtacgaacaacatggttgtcatacagacggagtaccgtacgaacaacatggttgtcatacagacggagtaccatacaaacaacatggttgtcgtacagacggagtactatacaaacaacatggttgtcgtacagacagatcaagagatgaacaacttgattatgtgacaaaaacgattgatgtattccctgatactgataaagtacgtatcgacattggagaaaccgaaggtacctttaaagtagaaagtgtggaactgatttttatggaagagtaa

SEQ ID NO: 4 - protein, 1295 aa, Brevibacillus laterosporus
  MISC_FEATURE (1)..(1295): The amino acid sequence of the TIC7040HT protein.
MNQNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIGGSLSEYETKHQLEKARKAVNDLFTNESKNVLKKYTTDYDIDQAANLVECVSDECANAKMILLDEVKYAKQLSEARNLLLNGNFEYQDRDGENPWKTSPNVTIQENNPIFKGRYLSMSGANYIEATNDTFPTYAYQKIDEAKLKPYTRYKVRGFVGNSKDLELLIKRYDEEVDAILNVPNDIPHAPTPFCGGFDRCKPHSYIPMNPECHHDVINNIEISSPCQHNKMLDNADISSRHSELGKKRGICHESHHFEFHIDTGKIDLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVTYEQSNYHTDGVPYEQSNYPTDGVPYEQHGCHTDGVPYEQSNYPTDGVPYEQHGCHTDGVPYEQHGCHTDGVPYEQHGCHTDGVPYKQHGCRTDGVLYKQHGCRTDRSRDEQLDYVTKTIDVFPDTDKVRIDIGETEGTFKVESVELIFMEE

SEQ ID NO: 5 - DNA, 2016 bp, Artificial
  A nucleic acid encoding a TIC7040HT_4 pesticidal protein sequence which comprises a C-terminal truncation relative to the TIC7040HT protein.
atgaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggggttctttgtctgagtatgaaaccaaacatcagctagaaaaagcaaggaaagcggtgaactaa

SEQ ID NO: 6 - protein, 671 aa, Artificial
  The amino acid sequence of the TIC7040HT_4 protein, consisting of amino acids 1 through 671 of TIC7040HT.
MNQNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIGGSLSEYETKHQLEKARKAVN

SEQ ID NO: 7 - DNA, 1923 bp, Artificial
  A nucleic acid encoding a TIC7040HT_5 pesticidal protein sequence which comprises an N-terminal and C-terminal truncation relative to the TIC7040HT protein.
atgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggtaa

SEQ ID NO: 8 - protein, 600 aa, Artificial
  The amino acid sequence of the TIC7040HT_5 protein, comprising amino acids 13 through 611 of TIC7040HT.
MQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRV

SEQ ID NO: 9 - DNA, 1983 bp, Artificial
  A nucleic acid encoding a TIC7040HT_6 pesticidal protein sequence which comprises an N-terminal and C-terminal truncation relative to the TIC7040HT protein.
atgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggggttctttgtctgagtatgaaaccaaacatcagctagaaaaagcaaggaaagcggtgaactaa

SEQ ID NO: 10 - protein, 660 aa, Artificial
  The amino acid sequence of the TIC7040HT_6 protein, comprising amino acids 13 through 671 of TIC7040HT.
MQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIGGSLSEYETKHQLEKARKAVN

SEQ ID NO: 11 - DNA, 3801 bp, Brevibacillus laterosporus
  misc_feature (1)..(3801): A nucleic acid encoding a TIC7042 pesticidal protein sequence obtained from Brevibacillus laterosporus species DSC005973.
atgaatcagaatcaaaataaaaatgaaatgcaaatcatagaaccttcaagtgattcttttctttatagtcacaacaattatccgtatgctactgatccagatacaatattaaaaggtaggaattataaagagtggctaaatatgtgtacagatacagacgattcacgaagtcccgaagctgcttctactgcaagatcagctatttctgttgcgattactataagcaccacaattcttggcttactaggtgttccgtttgcatctcaaattggagcattttataacttcgtattgaatacggtatggcctcagggaaataaccaatgggaagagttcatgagacatgtagaaaatctcataaacgaacgaatagctgattatgcaagagataaggcacttgcagaattaacgggtttaggtaataacttaaatttatatagagaagcttttgaagattggagacgaaatcctactagtcaagaagctaaaacccgtgtaatagatagattccgtatactagatggtttatttgaaacatatatgccttcatttgcagtacgaaattttgaagtacaattattaacagtgtatgcatccgctgcaaatatccatttatttttattaagagatagctctatttacggtttggattggggattaagtcaaactaatgttaacgaaaattacaatcgccaaataaggcacgccgcaacgtatgcaaatcattgtacaacttggtatcaaactggtttacaaagattgcaaggtaccaatgctaccagttgggtcgcttataatagatttagaagagaaatgacgttaacagtattagatatttgttcattattttcaaattatgattatcgtagttatccaacagaggtaaagggagagcttacgagagaaatttatacggatccagtaggtagaaactggcagaatgttgcaccatcattcgctgaaatagaaaatctaacaattagggcaccaagaaccgttacttggttaaattcaacaagaatttttacagggactttgacaggctggagtggttctaacagatattgggcagctcacatgcaaaacttttcagaaaccaattcaggaaatataggatttgacggtcctcaatatgggtcgacggtaggtactattcatcgtactgatgattacgatatggtgaatcgagatatttacaccattacttcacaagctgttgccgccctttggccaactggtcaaactgtgttgggagtcgcttcgactagatttactttaagaaaccttaacaataattctacagaggcgctggtgtatgagaacgcaataagttcaagttttgttagttcaactttaactcatgaattacctggagaaaactcagataggccaacttctagcgactatagtcatagactatcgagtatcacaggttttcgagctggagctaatggaacggtcccagtgtttggttggacatctgcaactgttgatcgtaacaatataattgagcaaaacaaaataacacaattcccaggtgttaagtcacacactctcaacaattgtcaagtagttaggggtactggatttacaggaggagactggttgagaccaaataataatggtacatttagactaactattacttcattctccagccaatcttaccgaattcgcttacgttatgctacttcagtagggaatacttctttagttatatcttcttctgatgcaggtatttcttccacaacaattccgcttacctcaacaataacatcactgccacaaactgtaccataccaagcttttagggttgtagatttacctattacttttacaacacctactacccaaagaaattatacgtttgatttccgtctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaagacacgaccgattatgatatagatcaagctgcaaacttggtagaatgtgtatctgatgaatgtgcaaatgctaaaatgatcctattagatgaagtaaaatatgcgaaacaacttagcgaagcccgcaatctacttctaaatggtaattttgaataccaagatagagatggggagaatccatggaaaacaagtcccaatgttaccatccaagagaataaccccatttttaaaggccgctatctcagtatgtcaggtgcgaacaatatcgaggcaaccaatgagatatttcccacttatgtataccaaaaaattgatgaatccaaattaaaaccttatacccgttataaagttcgaggttttgttggaaatagtaaagatttagaattattggttacacggtatgatgaagaagtagatgcgattttaaatgtatcaaatgatataccacatgctccgccacctttctgcggtgaatttgatcgatgcaagccgcattcttatcctcctattaatccagaatgtcaccatgatgtaataaataacattgaaatatcctctccttgccaacacaataagatggtagatagcgctgatatatcttatcgccatagccgaataagtaaaaaacatggcatttgtcatgaatctcatcattttgaattccatattgatacagggaaaatcgatttggtcgaaaatttgggaatttgggttatatttaaaatatgttccacagatggttacgcaacattagataatttggaagttattgaagagggtcctttaggagccgaatccttagaacgtgtgaaaagaagagaaaagaaatggaaacatcacatggaacacaaatgttcagaaactaaacatgcatatcatgccgcaaaacaagcggtggtggcgttattcaccaactctaaatatgatagattaaagttcgaaacaaccatatccaatattctttttgctgattatctcgtgcagtcaattccgtatgtatataataaatggttaccaggtgttccaggtatgaattacgatatctatacagaattaaaaaatctgtttacgggagctttcaatctatatgatcagcgaaatattataaaaaatggagactttaatcgtgggctcatgcattggcatgcgacacctcatgcaagagtagagcaaataatagataataggtctgtgctagtgcttccaaattatgctgccaatgtttcacaagaggtttgtttagaacacaatcgtggttatgtattacgtgtaacggcgaaaaaagaaggccctggaattggatatgttacattcagtgattgtgcaaatcatatagaaaagcttacatttacttcttgcgattatggtacaaacgtagtgccatatgaacaatctaattatcctacagacggagtaccatatggacaacatggttgtaatatagacggagtaccgtatgaacaatccggttatcgtacagacggagtaccgtacgaacttggtcatcgtacagatggagtaccgtacgaacaatctggttatcgtacagacggagtaccatgcgaacaacatggttgtcatacagacggactaccacacatacaacatggttgtcgtacagacagatcaagagatgaactacttggttatgtgacaaaaacgattgatgtattccctaatacagataaagtacgtatcgacattggagaaaccgaaggtacttttaaagtagaaagtgtagaactgatttgtatggaagagtaa

SEQ ID NO: 12 - protein, 1266 aa, Brevibacillus laterosporus
  MISC_FEATURE (1)..(1266): The amino acid sequence of the TIC7042 protein.
MNQNQNKNEMQIIEPSSDSFLYSHNNYPYATDPDTILKGRNYKEWLNMCTDTDDSRSPEAASTARSAISVAITISTTILGLLGVPFASQIGAFYNFVLNTVWPQGNNQWEEFMRHVENLINERIADYARDKALAELTGLGNNLNLYREAFEDWRRNPTSQEAKTRVIDRFRILDGLFETYMPSFAVRNFEVQLLTVYASAANIHLFLLRDSSIYGLDWGLSQTNVNENYNRQIRHAATYANHCTTWYQTGLQRLQGTNATSWVAYNRFRREMTLTVLDICSLFSNYDYRSYPTEVKGELTREIYTDPVGRNWQNVAPSFAEIENLTIRAPRTVTWLNSTRIFTGTLTGWSGSNRYWAAHMQNFSETNSGNIGFDGPQYGSTVGTIHRTDDYDMVNRDIYTITSQAVAALWPTGQTVLGVASTRFTLRNLNNNSTEALVYENAISSSFVSSTLTHELPGENSDRPTSSDYSHRLSSITGFRAGANGTVPVFGWTSATVDRNNIIEQNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETKHQLEKARKAVNDLFTNESKNVLKKDTTDYDIDQAANLVECVSDECANAKMILLDEVKYAKQLSEARNLLLNGNFEYQDRDGENPWKTSPNVTIQENNPIFKGRYLSMSGANNIEATNEIFPTYVYQKIDESKLKPYTRYKVRGFVGNSKDLELLVTRYDEEVDAILNVSNDIPHAPPPFCGEFDRCKPHSYPPINPECHHDVINNIEISSPCQHNKMVDSADISYRHSRISKKHGICHESHHFEFHIDTGKIDLVENLGIWVIFKICSTDGYATLDNLEVIEEGPLGAESLERVKRREKKWKHHMEHKCSETKHAYHAAKQAVVALFTNSKYDRLKFETTISNILFADYLVQSIPYVYNKWLPGVPGMNYDIYTELKNLFTGAFNLYDQRNIIKNGDFNRGLMHWHATPHARVEQIIDNRSVLVLPNYAANVSQEVCLEHNRGYVLRVTAKKEGPGIGYVTFSDCANHIEKLTFTSCDYGTNVVPYEQSNYPTDGVPYGQHGCNIDGVPYEQSGYRTDGVPYELGHRTDGVPYEQSGYRTDGVPCEQHGCHTDGLPHIQHGCRTDRSRDELLGYVTKTIDVFPNTDKVRIDIGETEGTFKVESVELICMEE

SEQ ID NO: 13 - DNA, 3810 bp, Brevibacillus laterosporus
  misc_feature (1)..(3810): A nucleic acid encoding a TIC7381 pesticidal protein sequence obtained from Brevibacillus laterosporus species DSC006713.
atgaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtgggtgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttgcctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaatacacgaccgattatgatatagatcaagctgcaaacttggtagaatgtgtatctgatgaatgtgcaaatgctaaaatgatcctattagatgaagtaaaatatgcgaaacaactcagcgaagcccgcaatctacttctgaatggtaattttgaataccaagatagagatggggagaatccatggaaaacaagtccaaatgttactatccaggaaaataaccccatttttaaaggccgttatctcagtatgtcgggtgcaaactatatcgaggcaacaaatgatactttccccacttatgcataccaaaaaatagatgaagcaaaattaaaaccctatacccgttataaagttcgagggtttgttggaaatagtaaagatttagagttgttgattaaacggtatgatgaagaagtggatgcgattttaaatgtaccaaatgatataccacatgctccgacacctttctgcggtggatttgatcgatgcaagccacattcttatattcctatgaatccagaatgtcaccatgatgtaataaataacattgaaatatcctctccttgccaacacaataagatgttggataacgctgatatatcttctcgccatagtgaattaggtaaaaaacatggaatttgtcatgaatctcatcattttgaattccatattgatacaggaaaaatccatttgaacgaaaatttgggaatttgggttatatttaaaatatgttccacagatggttacgcaacattagataatttggaagttattgaagagggtcctttaggagccgaatcattagaacgtgtgaaaagaagagaaaagaaatggaaacatcacatggaacacaagtgttcagaaactaaacttgcatatcatgctgcaaaacaagcgctggtggggttattcacaaacactaaatatgatagattaaagttcgaaacaaccatatccaatattctttttgctgattatctcgtgcagtcaattccgtatgtatataataaatggttaccagatgttccaggtatgaattacgatatctatacagaattaaaaaatctgtttacgggagctttcaatctatatgatcagcgaaatattataaaaaatggagactttaatcgcgggctcatgcattggcatgcgacacctcatgcaagagtagagcaaatagataataggtctgtgctggtgcttccaaattatgctgccaatgtttcacaagaggtttgtttagaacacaatcgtggttatgtattacgtgtaacggcgaaaaaagaaggccctggaattggatatgttacattcagtgattgtgcaaataatatagaaaaactgacatttacttcttgcgattatggtacaaacgaagtgacatatgagcaatctaattatcctacagacggagtaccgtacgaacaacatggttgtcatacagacggagtaccgtacgaacaacatggttgtcatacagacggagtaccgtacgaacaacatggttgtcatacagacggaataccatacaaacaacatggttgtcgtacagacggagtaccatacaaacaacatggttgtcgtacagacggagtaccatacaaacaacatggttgtcgtacagacagatcaagagatgaacaacttgattatgtgacaaaaacgattgatgtattccctgatactgataaagtacgtatcgacattggagaaaccgaaggtacctttaaagtagaaagtgtggaactgatttttatggaagagtaa

SEQ ID NO: 14 - protein, 1269 aa, Brevibacillus laterosporus
  MISC_FEATURE (1)..(1269): The amino acid sequence of the TIC7381 protein.
MNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWVNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLASTITSLPQTAVPYEAFRVIDLPITFTTATQSNYTFDFVLQNPSNANVFIDRFEFVPIGGSLSEYETKHQLEKARKAVNDLFTNESKNVLKKYTTDYDIDQAANLVECVSDECANAKMILLDEVKYAKQLSEARNLLLNGNFEYQDRDGENPWKTSPNVTIQENNPIFKGRYLSMSGANYIEATNDTFPTYAYQKIDEAKLKPYTRYKVRGFVGNSKDLELLIKRYDEEVDAILNVPNDIPHAPTPFCGGFDRCKPHSYIPMNPECHHDVINNIEISSPCQHNKMLDNADISSRHSELGKKHGICHESHHFEFHIDTGKIHLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVTYEQSNYPTDGVPYEQHGCHTDGVPYEQHGCHTDGVPYEQHGCHTDGIPYKQHGCRTDGVPYKQHGCRTDGVPYKQHGCRTDRSRDEQLDYVTKTIDVFPDTDKVRIDIGETEGTFKVESVELIFMEE

SEQ ID NO: 15 - DNA, 3741 bp, Brevibacillus laterosporus
  misc_feature (1)..(3741): A nucleic acid encoding a TIC7382 pesticidal protein sequence obtained from Brevibacillius laterosporus species DSC007657.
atgaatcagaatcagaatcaaaataaaaatgaaatgcaaattatagaaccttcaagtgattcttttctttatagtcacaacaattatccgtatgcaactgatccaaatacagtattagaaggtaggaattataaagagtggctaaataagtgtacaaataattatacagacgctttacagagtcccgaagctactgctatttcaaaaggagctgtttctgctgcgatttctataagcaccaaagttcttggtttattaggtgttccatttgcagctcaaatcgggcaactttggaccttcatattaaatgcgttatggccttcagacaatactcaatgggaagagttcatgagacatgtagaagaactcataaaccaacgaatagccgattatgcaagaaataaggcacttgcagaattaacgggtttaggtaataatctagatttatatatagaggctcttgatgattggaaacgaaatcctactagtcaagaagctaaaacccgtgtaatagatagattccgtatagtagatggattatttgaagcatatataccttcatttgcagtatcaggttatcaagtacaattattaacggtgtatgcagccgctgcaaatctccacttacttttattaagagattccactatttacggaattgattggggattaagtcaaactaatgttaatgataattacaatcgccaaataagactcaccgcaacgtatgcaaatcattgtacaacttggtatcaaactggtttagaaagattgaggggttccaatgcttccagttgggtcacttataataggtttcgaagagaaatgacgttaaccgtattggatatttgctccttattttcaaattatgattatcgtagttacccagcagaggtaaggggagagattacgagagaaatttatacggacccagtaggtgtaggctgggtggatagtgcaccatcattcggagaaatagaaaatctagcaattagggcgccaagaaccgttacttggttaaattcaacaagaatttctacagggaccttgagtggctggagtggttctaacagatattgggcagctcacatgcaaaacttttcagaaaccaattcaggaaatataggatttgacggtcctctctatgggtcgacggtaggtactattcatcgtactgatgattacgatatggggaatcgagatatttacaccattacttcacaagctgttttaggcctttggccaactggtcaaagggtgttgggagtcgcttcggctagatttactttaagaaatcttttcaataatcttacacaggtgctggtgtatgagaacccaataagttcaaattttggaagttcaactttaactcatgaattatctggagaaaactcagataggccaacttctagcgactatagtcatagactaacgagtatcacaggttttcgagctggagctaatggaacggtcccagtgtttggttggacatctgcaactgttgatcgtaacaatataattgagcgaaacaaaataacacaattcccaggtgttaagtcacacactctcaacaattgtcaagtagttaggggtactggatttacaggaggagactggttgagaccaaataataatggtacatttagactaactattacttcattctcgagccaatcttaccgaatccgcttacgttatgctacttcagtagggaatacttctttagttatatcttcttctgatgcaggtatttcttccacaacaattccgcttacctcaacaataacatcactgccccaaactgtaccataccaggcttttagggttgtagatttacctattacttttacaacacctactacccaaagaaattatacgtttgatttccgtctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaagaaactactgattatgacatagatcaagcagcaaacttggtagaatgtatatcagatgaatgtgcaaatgcaaaaatgatcctattagatgaagtaaaatatgcgaaacaactcagcgaagcccgcaatctacttctaaatggtaattttgataacctagatagaaatggggagaatccatggaaaacaagtcccaatgttaccatccaagagaataaccccatttttaaaggccgctatctcagtatgtcaggtgcgaacaatatcgaggccaccaatgagatatttcccacttatgtataccaaaaaatagatgaagcaaaattaaaaccttatacccgttataaagttcgagggtttgttggaagtagtaaagatttagaattattggttacacggtatgatgaagaagtagatgcaattttaaatgtactaaatgatataccacatgctccgccacctttctgcggtggatttgatcgatgcaagccacattcttatcctcctatgaatccagaatgtcaccatgatgtaataaataacattgaaatatcctctccttgccaacacaataagatgttggataacgctgatatattttctcgccatagtgaattaggtaaaaaacatggaatttgtcatgaatctcatcattttgaattccatattgatacaggaaaaatcgatttgaacgaaaatttgggaatttgggttatatttaaaatatgttccacagatggttacgcaacattagataatttggaagttattgaagagggtcctttaggagccgaatcattagaacgtgtgaaaagaagagaaaagaaatggaaacatcacatggaacacaagtgttcagaaactaaacttgcatatcatgctgcaaaacaagcgctggtagggttattcacaaacactaaatatgatagattaaagttcgaaacaactatatccaatattctttttgctgattatctcgtgcagtcaattccgtatgtatataataaatggttaccagatgttccaggtatgaattacgatatctatacagaattaaaaaatctgtttacgggagctttcaatctatatgatcagcgaaatattataaaaaatggagactttaatcgcgggctcatgcattggcatgcgacacctcatgcaagagtagagcaaatagataataggtctgtgctggtgcttccaaattatgctgccaatgtttcacaagaggtttgtttagaacacaatcgtggttatgtattacgtgtaacggcgaaaaaagaaggccctggaattggatatgttacatttagtgattgtgcaaataatatagaaaagctgacatttacttcttgcgattatggtacaaacgaagtgccatatgaacaatctggttatggtacaaacgaagtgccatatgaacaatctggttatggtacaaacgaagtgccatatgaacaatctggttatcgtacagacggagtaccatacaaacaacatggttgtcgtacagacggagtaccgtacgaacaatctggttgtcgtacagacagatcaagagatgaacaacttgattatgtgacaaaaacgattgatgtattccctgatacagataaagtacgtatcgacattggagaaaccgaaggtacctttaaagtagaaagtgtggaactgttttgtatggaagagtaa

SEQ ID NO: 16 - protein, 1246 aa, Brevibacillus laterosporus
  MISC_FEATURE (1)..(1246): The amino acid sequence of the TIC7382 protein.
MNQNQNQNKNEMQIIEPSSDSFLYSHNNYPYATDPNTVLEGRNYKEWLNKCTNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNIIERNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETKHQLEKARKAVNDLFTNESKNVLKKETTDYDIDQAANLVECISDECANAKMILLDEVKYAKQLSEARNLLLNGNFDNLDRNGENPWKTSPNVTIQENNPIFKGRYLSMSGANNIEATNEIFPTYVYQKIDEAKLKPYTRYKVRGFVGSSKDLELLVTRYDEEVDAILNVLNDIPHAPPPFCGGFDRCKPHSYPPMNPECHHDVINNIEISSPCQHNKMLDNADIFSRHSELGKKHGICHESHHFEFHIDTGKIDLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVPYEQSGYGTNEVPYEQSGYGTNEVPYEQSGYRTDGVPYKQHGCRTDGVPYEQSGCRTDRSRDEQLDYVTKTIDVFPDTDKVRIDIGETEGTFKVESVELFCMEE

SEQ ID NO: 17 - DNA, 3771 bp, Brevibacillus laterosporus
  misc_feature (1)..(3771): A nucleic acid encoding a TIC7383 pesticidal protein sequence obtained from Brevibacillus laterosporus species DSC008106.
atgaatcagaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgtacagataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtcttctgtatttgaatatgaaaccaagcatgagctagaaaaagctaagaaagcggtgaacgatttgtttaccaatgaatcgaaaaatatgttaaaaaaagacacaaccgattatgatatagatcaagctgcggacttggtagaatgtgtatcagatgaatgcgcacatgccaagatgatactactagatgaagtgaaatatgcaaaacagctcagcgaagcccgtaatctacttcaaaatggtaattttaaagtcctagatgtagataataataatccatggactaccagccccaatgttaccatccaagagaataaccccatttttaaaggtcattatcttagtatgtcgggtgcaaacgctatcgaggcaacgaatgaagtattccccacttatgtataccaaaaaatagaggaatcaaaactaaaaccatatacccgttataaagttcgtggttttattgggcaaagtaaagatgtagagttgttggttacacgatatgacgaagaagtagatgcgattctaaatgtacccaatgacttaaaatatgctgttccgacacatttaagtggtgaatttaatcgatgcaaaccacacacttatccagctacggatccaagatgtcacgatgatgtaatagataagattgatatatcctctccatgccaaaacaatattatgttaagtgacgctgatatatcttctctccatagtggattaggtaaaaaacatggcatttgtcatgaatctcatcattttgaattccatattgatactgggaaaatcgatttggtcgaaaatttgggaatttgggttatatttaaaatatgttccacagatggttacgcaacattagataatctggaagttattgaagagggtcctttaggagccgaatcattagaacgtgtgaaaagaagagaaaagaaatggaaacacaacatggaacataagtgttcagaaacgaaacatgcctatcatgccgcaaaacaagcggtggaggcgttattcacaaattttaaagatgaaagattgaagttcgaaacaacgatctccaatattctttcagctgagtatcttgtccagtccattccgtatgtatataataaatggctatcagatgttccaggtatgaattatgacatatatacagaattaaaaaatcggatctggcaagcttttaatttatatgatcagcgaaatattattaaaaatggacactttaaccacgggctcatgcattggcatgcgacacctcatgcaaacgtacagcaaatagatggtatatctgtgttagtgcttccaaattggggtgccaatgtttcacaagaggtttgtttaaaacacaatcgcggttatgtattacgtgtaacagccaaagaagaaggccatggaaagggatatgttacaatcagtgattgtgcaaatcaagtagaaaagctgtcatttacttctcgcgattatagtacagacggagtgccatatgagcaatctaattatcctacagacggagtttcatacggacaacatggttgtaatatagacagagtaccgtacgaacaatctggttatcctacagacggagtaccgtacgaacaatctggttatcgtacagacggagtaccatacaaacaacatggttgtcattcagacggatcaagagaagaacaacatggttacgtgacaaaaacgattgatgtattccctgatacagataaagtacgtatcgacattggagaaaccgaaggtacctttaaagtagaaagtgtggaactgatttgtatggaagagtaa

SEQ ID NO: 18 - protein, 1256 aa, Brevibacillus laterosporus
  MISC_FEATURE (1)..(1256): The amino acid sequence of the TIC7383 protein.
MNQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERVKRREKKWKHNMEHKCSETKHAYHAAKQAVEALFTNFKDERLKFETTISNILSAEYLVQSIPYVYNKWLSDVPGMNYDIYTELKNRIWQAFNLYDQRNIIKNGHFNHGLMHWHATPHANVQQIDGISVLVLPNWGANVSQEVCLKHNRGYVLRVTAKEEGHGKGYVTISDCANQVEKLSFTSRDYSTDGVPYEQSNYPTDGVSYGQHGCNIDRVPYEQSGYPTDGVPYEQSGYRTDGVPYKQHGCHSDGSREEQHGYVTKTIDVFPDTDKVRIDIGETEGTFKVESVELICMEE

SEQ ID NO: 19 - DNA, 3732 bp, Artificial
  A nucleic acid encoding a TIC7383_2 protein which comprises an N-terminal truncation relative to the TIC7383 protein.
atgcaaatcatagaaccttcaagtgattctttgctttatagtcacaacaattatccgtatgcaactgatccaaatacagtattagaaggtaggaattataaagagtggctaaataagtgtacagataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtcttctgtatttgaatatgaaaccaagcatgagctagaaaaagctaagaaagcggtgaacgatttgtttaccaatgaatcgaaaaatatgttaaaaaaagacacaaccgattatgatatagatcaagctgcggacttggtagaatgtgtatcagatgaatgcgcacatgccaagatgatactactagatgaagtgaaatatgcaaaacagctcagcgaagcccgtaatctacttcaaaatggtaattttaaagtcctagatgtagataataataatccatggactaccagccccaatgttaccatccaagagaataaccccatttttaaaggtcattatcttagtatgtcgggtgcaaacgctatcgaggcaacgaatgaagtattccccacttatgtataccaaaaaatagaggaatcaaaactaaaaccatatacccgttataaagttcgtggttttattgggcaaagtaaagatgtagagttgttggttacacgatatgacgaagaagtagatgcgattctaaatgtacccaatgacttaaaatatgctgttccgacacatttaagtggtgaatttaatcgatgcaaaccacacacttatccagctacggatccaagatgtcacgatgatgtaatagataagattgatatatcctctccatgccaaaacaatattatgttaagtgacgctgatatatcttctctccatagtggattaggtaaaaaacatggcatttgtcatgaatctcatcattttgaattccatattgatactgggaaaatcgatttggtcgaaaatttgggaatttgggttatatttaaaatatgttccacagatggttacgcaacattagataatctggaagttattgaagagggtcctttaggagccgaatcattagaacgtgtgaaaagaagagaaaagaaatggaaacacaacatggaacataagtgttcagaaacgaaacatgcctatcatgccgcaaaacaagcggtggaggcgttattcacaaattttaaagatgaaagattgaagttcgaaacaacgatctccaatattctttcagctgagtatcttgtccagtccattccgtatgtatataataaatggctatcagatgttccaggtatgaattatgacatatatacagaattaaaaaatcggatctggcaagcttttaatttatatgatcagcgaaatattattaaaaatggacactttaaccacgggctcatgcattggcatgcgacacctcatgcaaacgtacagcaaatagatggtatatctgtgttagtgcttccaaattggggtgccaatgtttcacaagaggtttgtttaaaacacaatcgcggttatgtattacgtgtaacagccaaagaagaaggccatggaaagggatatgttacaatcagtgattgtgcaaatcaagtagaaaagctgtcatttacttctcgcgattatagtacagacggagtgccatatgagcaatctaattatcctacagacggagtttcatacggacaacatggttgtaatatagacagagtaccgtacgaacaatctggttatcctacagacggagtaccgtacgaacaatctggttatcgtacagacggagtaccatacaaacaacatggttgtcattcagacggatcaagagaagaacaacatggttacgtgacaaaaacgattgatgtattccctgatacagataaagtacgtatcgacattggagaaaccgaaggtacctttaaagtagaaagtgtggaactgatttgtatggaagagtaa

SEQ ID NO: 20 - protein, 1243 aa, Artificial
  The amino acid sequence of the TIC7383_2 protein, comprising amino acids 15 through 1256 of TIC7383.
MQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERVKRREKKWKHNMEHKCSETKHAYHAAKQAVEALFTNFKDERLKFETTISNILSAEYLVQSIPYVYNKWLSDVPGMNYDIYTELKNRIWQAFNLYDQRNIIKNGHFNHGLMHWHATPHANVQQIDGISVLVLPNWGANVSQEVCLKHNRGYVLRVTAKEEGHGKGYVTISDCANQVEKLSFTSRDYSTDGVPYEQSNYPTDGVSYGQHGCNIDRVPYEQSGYPTDGVPYEQSGYRTDGVPYKQHGCHSDGSREEQHGYVTKTIDVFPDTDKVRIDIGETEGTFKVESVELICMEE

SEQ ID NO: 21 - DNA, 1980 bp, Brevibacillus laterosporus
  misc_feature (1)..(1980): A nucleic acid encoding a TIC7383_3 protein which comprises a C-terminal truncation relative to the TIC7383 protein.
atgaatcagaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgtacagataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtaa

SEQ ID NO: 22 - protein, 659 aa, Brevibacillus laterosporus
  MISC_FEATURE (1)..(659): The amino acid sequence of the TIC7383_3 protein and consists of amino acids 1 through 659 of TIC7383.
MNQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVG

SEQ ID NO: 23 - DNA, 2040 bp, Brevibacillus laterosporus
  misc_feature (1)..(2040): A nucleic acid encoding a TIC7383_4 protein which comprises a C-terminal truncation relative to the TIC7383 protein.
atgaatcagaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgtacagataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtcttctgtatttgaatatgaaaccaagcatgagctagaaaaagctaagaaagcggtgaactaa

SEQ ID NO: 24 - protein, 679 aa, Brevibacillus laterosporus
  MISC_FEATURE (1)..(679): The amino acid sequence of the TIC7383_4 protein and consists of amino acids 1 through 679 of TIC7383.
MNQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVN

SEQ ID NO: 25 - DNA, 1941 bp, Artificial
  A nucleic acid encoding a TIC7383_5 protein which comprises an N-terminal and C-terminal truncation relative to the TIC7383 protein.
atgcaaatcatagaaccttcaagtgattctttgctttatagtcacaacaattatccgtatgcaactgatccaaatacagtattagaaggtaggaattataaagagtggctaaataagtgtacagataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtaa

SEQ ID NO: 26 - protein, 646 aa, Artificial
  The amino acid sequence of the TIC7383_5 protein and comprises amino acids 15 though 659 of TIC7383.
MQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVG

SEQ ID NO: 27 - DNA, 2001 bp, Artificial
  A nucleic acid encoding a TIC7383_6 protein which comprises an N-terminal and C-terminal truncation relative to the TIC7383 protein.
atgcaaatcatagaaccttcaagtgattctttgctttatagtcacaacaattatccgtatgcaactgatccaaatacagtattagaaggtaggaattataaagagtggctaaataagtgtacagataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtcttctgtatttgaatatgaaaccaagcatgagctagaaaaagctaagaaagcggtgaactaa

SEQ ID NO: 28 - protein, 666 aa, Artificial
  The amino acid sequence of the TIC7383_6 protein, comprising amino acids 15 through 679 of TIC7383.
MQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVN

SEQ ID NO: 29 - DNA, 3840 bp, Brevibacillus laterosporus
  misc_feature (1)..(3840): A nucleic acid encoding a TIC7386 pesticidal protein sequence obtained from Brevibacillus laterosporus species DSC007651.
atgaatcagaatcaaaataaaaatgaactgcaaatcatagaaccttcaagcgattcttttctttatagtcacaacaattatccgtatgctactgatccagatacaatattaaaaggtaggaattataaagagtggctaaatatgtgtacagatacagacgattcacgaagtcccgaagctgcttctactgcaagatcagctatttctgttgcgattactataagcaccacaattcttggcttactaggtgttccgtttgcatctcaaattggagcattttataacttcgtattgaatacggtatggcctcagggaaataaccaatgggaagagttcatgagacatgtagaaaatctcataaacgaacgaatagctgattatgcaagagataaggcacttgcagaattaacgggtttaggtaataacttaaatttatatagagaagcttttgaagattggagacgaaatcctactagtcaagaagctaaaacccgtgtaatagatagattccgtatactagatggtttatttgaaacatatatgccttcatttgcagtacgaaattttgaagtacaattattaacagtgtatgcatccgctgcaaatatccatttatttttattaagagatagctctatttacggtttggattggggattaagtcaaactaatgttaacgaaaattacaatcgccaaataaggcacgccgaaacgtatgcaaatcattgtacaacttggtatcaaactggtttacaaagattgcaaggtaccaatgctaccagttgggtcgcttataatagatttagaagagaaatgacgttaacagtattagatatttgttcattattttcaaattatgattatcgtagttatccaacagaggtaaggggagagcttacgagagaaatttatacggatccagtaggtagaaactggcagaatgttgcaccatcattcgctgaaatagaaaatctaacaattagggcaccaagaaccgttacttggttaaattcaacaagaatttttacagggactttgacaggctggagtggttctaacagatattgggcagctcacatgcaaaacttttcagaaaccaattcaggaaatataggatttgacggtcctcaatatgggtcgacggtaggtactattcatcgtactgatgattacgatatggtgaatcgagatatttacaccattacttcacaagctgttgccgccctttggccaactggtcaaactgtgttgggagtcgcttcgactagatttactttaagaaaccttaacaataattctacagaggcgctggtgtatgagaacgcaataagttcaagttttgttagttcaactttaactcatgaattacctggagaaaactcagataggccaacttctagcgactatagtcatagactatcgagtatcacaggttttcgagctggagctaatggaacggtcccagtgtttggttggacatctgcaactgttgatcgtaacaatataattgagcaaaacaaaataacacaattcccaggtgttaagtcacacactctcaacaattgtcaagtagttaggggtactggatttacaggaggagactggttgagaccaaataataatggtacatttagactaactattacttcattctccagccaatcttaccgaattcgcttacgttatgctacttcagtagggaatacttctttagttatatcttcttctgatgcaggtatttcttccacaacaattccgcttacctcaacaataacatcactgccacaaactgtaccataccaagcttttagggttgtagatttacctattacttttacaacacctactacccaaagaaattatacgtttgatttccgtctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaagacacgaccgattatgatatagatcaagctgcaaacttggtagaatgtgtatctgatgaatgtgcaaatgctaaaatgatcctattagatgaagtaaaatatgcgaaacaacttagcgaagcccgcaatctacttctaaatggtaattttgaataccaagatagagatggggagaatccatggaaaacaagtcccaatgttaccatccaagagaataaccccatttttaaaggccgctatctcagtatgtcaggtgcgaacaatatcgaggcaaccaatgagatatttcccacttatgtataccaaaaaattgatgaatccaaattaaaaccttatacccgttataaagttcgaggttttgttggaaatagtaaagatttagaattattggttacacggtatgatgaagaagtagatgcgattttaaatgtaccaaatgatataccacatgctccgccacctttctgcggtgaatttgatcgatgcaagccgcattcttatcctcctattaatccagaatgtcaccatgatgtaataaataacattgaaatatcctctccttgccaacacaataagatggtagataacgctgatatatcttatcgccatagccgattaagtaaaaaacatggcatttgtcatgaatctcatcattttgaattccatattgatacagggaaaatcgatttggccggaaatttgggaatttgggttatatttaaaatatgttccacagatggttacgcaacattagataatttggaagttattgaagagggtcctttaggagccgaatccttagaacgtgtgaaaagaagagaaaagaaatggaaacatcacatggaacacaaatgttcagaaactaaacatgcatatcatgccgcaaaacaagcggtggtggcgttattcaccaactctaaatatgatagattaaagttcgaaacaaccatatccaatattctttttgctgattatctcgtgcagtcaattccgtatgtatataataaatggttaccaggtgttccaggtatgaattacgatatctatacagaattaaaaaatctgtttacgggagctttcaatctatatgatcagcgaaatattataaaaaatggagactttaatcgtgggctcatgcattggcatgcgacacctcatgcaagagtagagcaaataatagataataggtctgtgctagtgcttccaaattatgctaccaatgtttcacaagaggtttgtttagaacacaatcgtggttatgtattacgtgtaacggcgaaaaaagaaggccctggaattggatatgttacattcagtgattgtgcaaatcatatagaaaagcttacatttacttcttgcgattatggtacaaacgtagtgccatatgaacaatctaattatcctacagacggagtaccatatggacaacatggttgtaatatagacggagtaccgtatgaacaatccggttatcgtacagacggagtaccgtacgaacaatctggtcatcgtacagatggagtaccgtacgaacaatctggttatcgtacagacggagaaccatgcgaacaacatggttgtcatacagacggactaccacacatacaacatggttgtcgtacagacggactaccacacatacaacatggttgtcgtacagacagatcaagagatgaactacttggttatgtgacaaaaacgattgatgtattccctaatacagataaagtacgtatcgacattggagaaaccgaaggtacttttaaagtagaaagtgtagaactgatttgtatggaagagtaa

SEQ ID NO: 30 - protein, 1279 aa, Brevibacillus laterosporus
  MISC_FEATURE (1)..(1279): The amino acid sequence of the TIC7386 protein.
MNQNQNKNELQIIEPSSDSFLYSHNNYPYATDPDTILKGRNYKEWLNMCTDTDDSRSPEAASTARSAISVAITISTTILGLLGVPFASQIGAFYNFVLNTVWPQGNNQWEEFMRHVENLINERIADYARDKALAELTGLGNNLNLYREAFEDWRRNPTSQEAKTRVIDRFRILDGLFETYMPSFAVRNFEVQLLTVYASAANIHLFLLRDSSIYGLDWGLSQTNVNENYNRQIRHAETYANHCTTWYQTGLQRLQGTNATSWVAYNRFRREMTLTVLDICSLFSNYDYRSYPTEVRGELTREIYTDPVGRNWQNVAPSFAEIENLTIRAPRTVTWLNSTRIFTGTLTGWSGSNRYWAAHMQNFSETNSGNIGFDGPQYGSTVGTIHRTDDYDMVNRDIYTITSQAVAALWPTGQTVLGVASTRFTLRNLNNNSTEALVYENAISSSFVSSTLTHELPGENSDRPTSSDYSHRLSSITGFRAGANGTVPVFGWTSATVDRNNIIEQNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETKHQLEKARKAVNDLFTNESKNVLKKDTTDYDIDQAANLVECVSDECANAKMILLDEVKYAKQLSEARNLLLNGNFEYQDRDGENPWKTSPNVTIQENNPIFKGRYLSMSGANNIEATNEIFPTYVYQKIDESKLKPYTRYKVRGFVGNSKDLELLVTRYDEEVDAILNVPNDIPHAPPPFCGEFDRCKPHSYPPINPECHHDVINNIEISSPCQHNKMVDNADISYRHSRLSKKHGICHESHHFEFHIDTGKIDLAGNLGIWVIFKICSTDGYATLDNLEVIEEGPLGAESLERVKRREKKWKHHMEHKCSETKHAYHAAKQAVVALFTNSKYDRLKFETTISNILFADYLVQSIPYVYNKWLPGVPGMNYDIYTELKNLFTGAFNLYDQRNIIKNGDFNRGLMHWHATPHARVEQIIDNRSVLVLPNYATNVSQEVCLEHNRGYVLRVTAKKEGPGIGYVTFSDCANHIEKLTFTSCDYGTNVVPYEQSNYPTDGVPYGQHGCNIDGVPYEQSGYRTDGVPYEQSGHRTDGVPYEQSGYRTDGEPCEQHGCHTDGLPHIQHGCRTDGLPHIQHGCRTDRSRDELLGYVTKTIDVFPNTDKVRIDIGETEGTFKVESVELICMEE

SEQ ID NO: 31 - DNA, 3810 bp, Brevibacillus laterosporus
  misc_feature (1)..(3810): A nucleic acid encoding a TIC7388 pesticidal protein sequence obtained from Brevibacillus laterosporus species DSC007962.
atgaatcagaatcaaaataaaaatgaaatgcaaattatagaaccttcaagtgattcttttctttatagtcacaacaattatccgtatgccactgatccaaatacagtattagaaggtaggaattataaagagtggctaaataagtgtacagataattatacagatgctttacagagtcccgaagctactgctatttcaaaaggagctgtttctgctgcgatttctataagcaccaaagttcttggtttattaggtgttccatttgcagctcaaatcgggcaactttggaccttcatattaaatgcgttatggccttcagacaatactcaatgggaagagttcatgagacatgtagaagaactcataaaccaacgaatagccgattatgcaagaaataaggcacttgcagaattaacgggtttaggtaataatctagatttatatatagaggctcttgatgattggaaacgaaatcctactagtcaagaagctaaaacccgtgtaatagatagattccgtatagtagatggattatttgaagcatatataccttcatttgcagtatcaggttatcaagtacaattattaacggtgtatgcagccgctgcaaatctccacttacttttattaagagattccactatttacggaattgattggggattaagtcaaactaatgttaatgataattacaatcgccaaataagactcaccgcaacgtatgcaaatcattgtacaacttggtatcaaactggtttagaaagattgaggggttccaatgcttccagttgggtcacttataataggtttcgaagggaaatgacgttaaccgtattggatatttgttccttattttcaaattatgattatcgtagttacccagcagaggtaaggggagagattacgagagaaatttatacggacccagtaggtgtaggctgggtggatagtgcaccatcattcggagaaatagaaaatctagcaattagggcaccaagaaccgttacttggttaaattcaacaagaatttttacagggagattgcagggctggagtggtactaacaattattgggcagctcacatgcaaaacttctcagaaaccaattcaggaaatatacaatttgaaggtcctctctatgggtcgacggtaggtactattcatcgtactgatgattacgatatggggaatcgagatatttacaccattacttcacaagctgttttaggcctttgggcaactggtcaaagggtgttgggggtcgcttcggctagatttactttaagaaatcttttcaataatcttacacaggtgctggtgtatgagaacccaataagttcaacttttggaagttcaactttaactcatgaattatctggagaaaactcagataggccaacttctagcgactatagtcatagactaacgagtatcacaggttttcgagctggagctaatggaacggtcccagtgtttggttggacatctgcaactgttgatcgtaacaatataattgagcgaaacaaaataacacaattcccaggtgttaagtcacacactctcaacaattgtcaagtagttaggggtactggatttacaggaggagactggttgagaccaaataataatggtacatttagactaactattacttcattctccagccaatcttaccgaattcgcttacgttatgctacttcagtagggaatacttctttagttatatcttcttctgatgcaggtatttcttccacaacaattccgcttacctcaacaataacatcactgccacaaactgtaccataccaagcttttagggttgtagatttacctattacttttacaacacctactacccaaagaaattatacgtttgatttccgtctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaagacacgaccgattatgatatagatcaagctgcaaacttggtagaatgtgtatctgatgaatgtgcaaatgctaaaatgatcctattagatgaagtaaaatatgcgaaacaacttagcgaagcccgcaatctacttctaaatggtaattttgaataccaagatagagatggggagaatccatggaaaacaagtcccaatgttaccatccaagagaataaccccatttttaaaggccgctatctcagtatgtcaggtgcgaacaatatcgaggcaaccaatgagatatttcccacttatgtataccaaaaaattgatgaatccaaattaaaaccttatacccgttataaagttcgaggttttgttggaaatagtaaagatttagaattattggttacacggtatgatgaagaagtagatgcgattttaaatgtaccaaatgatataccacatgctccgccacctttctgcggtgaatttgatcgatacaagccgcattcttatcctcctattaatccagaatgtcaccatgatgtaataaataacattgaaatatcctctccttgccaacacaataagatggtagataacgctgatatatcttatcgccatagccgattaagtaaaaaacatggcatttgtcatgaatctcatcattttgaattccatattgatacagggaaaatcgatttggtcgaaaatttgggaatttgggttgtatttaaaatatgttccacagatggttacgcaacattagataatttggaagttattgaagagggtcctttaggagccgaatccttagaacgtgtgaaaagaagagaaaagaaatggaaacatcacatggaacacaaatgttcagaaactaaacatgcatatcatgccgcaaaacaagcggtggtggcgttattcaccaactctaaatatgatagattaaagttcgaaacaaccatatccaatattctttttgctgattatctcgtgcagtcaattccgtatgtatataataaatggttaccaggtgttccaggtatgaattacgatatctatacagaattaaaaaatctgtttacgggagctttcaatctatatgatcagcgaaatattataaaaaatggagactttaatcgtgggctcatgcattggcatgcgacacctcatgcaagagtagagcaaataatagataataggtctgtgctagtgcttccaaattatgctgccaatgtttcacaagaggtttgtttagaacacaatcgtggttatgtattacgtgtaacggcgaaaaaagaaggccctggaattggatatgttacattcagtgattgtgcaaatcatatagaaaagcttacatttacttcttgcgattatggtacaaacgtagtgccatatgaacaatctaattatcctacagacggagtaccatatggacaacatggttgtaatatagacggagtaccgtatgaacaatccggttatcgtacagacggagtaccgtacgaacaatctggtcatcgtacagatggagtaccgtacgaacaatctggttatcgtacagacggagtaccatgcgaacaacatggttgtcatacagacggactaccacacatacaacatggttgtcgtacagacagatcaagagatgaactacttggttatgtgacaaaaacgattgatgtattccctaatacagataaagtacgtatcgacattggagaaaccgaaggtacttttaaagtagaaagtgtagaactgatttgtatggaagagtaa

SEQ ID NO: 32 - protein, 1269 aa, Brevibacillus laterosporus
  MISC_FEATURE (1)..(1269): The amino acid sequence of the TIC7388 protein.
MNQNQNKNEMQIIEPSSDSFLYSHNNYPYATDPNTVLEGRNYKEWLNKCTDNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRIFTGRLQGWSGTNNYWAAHMQNFSETNSGNIQFEGPLYGSTVGTIHRTDDYDMGNRDIYTITSQAVLGLWATGQRVLGVASARFTLRNLFNNLTQVLVYENPISSTFGSSTLTHELSGENSDRPTSSDYSHRLTSITGFRAGANGTVPVFGWTSATVDRNNIIERNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETKHQLEKARKAVNDLFTNESKNVLKKDTTDYDIDQAANLVECVSDECANAKMILLDEVKYAKQLSEARNLLLNGNFEYQDRDGENPWKTSPNVTIQENNPIFKGRYLSMSGANNIEATNEIFPTYVYQKIDESKLKPYTRYKVRGFVGNSKDLELLVTRYDEEVDAILNVPNDIPHAPPPFCGEFDRYKPHSYPPINPECHHDVINNIEISSPCQHNKMVDNADISYRHSRLSKKHGICHESHHFEFHIDTGKIDLVENLGIWVVFKICSTDGYATLDNLEVIEEGPLGAESLERVKRREKKWKHHMEHKCSETKHAYHAAKQAVVALFTNSKYDRLKFETTISNILFADYLVQSIPYVYNKWLPGVPGMNYDIYTELKNLFTGAFNLYDQRNIIKNGDFNRGLMHWHATPHARVEQIIDNRSVLVLPNYAANVSQEVCLEHNRGYVLRVTAKKEGPGIGYVTFSDCANHIEKLTFTSCDYGTNVVPYEQSNYPTDGVPYGQHGCNIDGVPYEQSGYRTDGVPYEQSGHRTDGVPYEQSGYRTDGVPCEQHGCHTDGLPHIQHGCRTDRSRDELLGYVTKTIDVFPNTDKVRIDIGETEGTFKVESVELICMEE

SEQ ID NO: 33 - DNA, 3960 bp, Brevibacillus laterosporus
  misc_feature (1)..(3960): A nucleic acid encoding a TIC7389 pesticidal protein sequence obtained from Brevibacillus laterosporus species DSC006878.
atgaatcagaatcagaatcaaaataaaaatgaactgcaaatcatagaaccttcaagtgattctttgctttatagtcacaacaattatccgtatgcaactgatccaaatacagtattagaaggtaggaattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtgggtgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttgcctcaacaataacatcactgccacaaactgctgtaccatatgaagcttttagagttatagatttacctattacttttacaacagctacccaaagtaattatacttttgattttgttctccaaaatccatcaaacgcaaatgtattcattgatagatttgaatttgttccaattgggggttctttgtctgagtatgaaaccaaacatcagctagaaaaagcaaggaaagcggtgaacgatttgtttaccaatgaatcgaaaaatgtgttaaaaaaatacacgaccgattatgatatagatcaagctgcaaacttggtagaatgtgtatctgatgaatgtgcaaatgctaaaatgatcctattagatgaagtaaaatatgcgaaacaactcagcgaagcccgcaatctacttctgaatggtaattttgaataccaagatagagatggggagaatccatggaaaacaagtccaaatgttaccatccaggaaaataaccccatttttaaaggccgttatctcagtatgtcgggtgcaaactatatcgaggcaacaaatgatactttccccacttatgcataccaaaaaatagatgaagcaaaattaaaaccctatacccgttataaagttcgagggtttgttggaaatagtaaagatttagagttgttgattaaacggtatgatgaagaagtggatgcgattttaaatgtaccaaatgatataccacatgctccgacacctttctgcggtggatttgatcgatgcaagccacattcttatattcctatgaatccagaatgtcaccatgatgtaataaataacattgaaatatcctctccttgccaacacaataagatgttggataacgctgatatatcttctcgccatagtgaattaggtaaaaaacgtggaatttgtcatgaatctcatcattttgaattccatattgatacaggaaaaatcgatttgaacgaaaatttgggaatttgggttatatttaaaatatgttccacagatggttacgcaacattagataatttggaagttattgaagagggtcctttaggagccgaatcattagaacgtgtgaaaagaagagaaaagaaatggaaacatcacatggaacacaagtgttcagaaactaaacttgcatatcatgctgcaaaacaagcgctggtggggttattcacaaacactaaatatgatagattaaagttcgaaacaaccatatccaatattctttttgctgattatctcgtgcagtcaattccgtatgtatataataaatggttaccagatgttccaggtatgaattacgatatctatacagaattaaaaaatctgtttacgggagctttcaatttatatgatcagcgaaatattataaaaaatggagactttaatcgcgggctcatgcattggcatgcgacacctcatgcaagagtagagcaaatagataataggtctgtgctggtgcttccaaattatgctgccaatgtttcacaagaggtttgtttagaacacaatcgtggttatgtattacgtgtaacggcgaaaaaagaaggccctggaattggatatgttacattcagtgattgtgcaaataatatagaaaaactgacatttacttcttgcgattatggtacaaacgaagtgacatatgagcaatctaattatcctacagacggagtaccgtacgaacaatctaattatcctacagacggagtaccgtacgaacaacatggttgtcatacagacggagttccgtacgaacaacctaattatcctacagacggagtaccgtacgaacaacatggttgtcatacagacggagtaccgtacgaacaacatggttgtcatacagacggagttccgtacgaacaacctaattatcctacagacggagtaccgtacgaacaacatggttgtcatacagacggagtaccgtacgaacaacatggttgtcatacagacggagtaccatacaaacaacatggttgtcgtacagacggagtaccatacaaacaacatggttgtcgtacagacagatcaagagatgaacaacttgattatgtgacaaaaacgattgatgtattccctgatactgataaagtacgtatcgacattggagaaaccgaaggtacctttaaagtagaaagtgtggaactgatttttatggaagagtaa

SEQ ID NO: 34 - protein, 1319 aa, Brevibacillus laterosporus
  MISC_FEATURE (1)..(1319): The amino acid sequence of the TIC7389 protein.
MNQNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWVNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLASTITSLPQTAVPYEAFRVIDLPITFTTATQSNYTFDFVLQNPSNANVFIDRFEFVPIGGSLSEYETKHQLEKARKAVNDLFTNESKNVLKKYTTDYDIDQAANLVECVSDECANAKMILLDEVKYAKQLSEARNLLLNGNFEYQDRDGENPWKTSPNVTIQENNPIFKGRYLSMSGANYIEATNDTFPTYAYQKIDEAKLKPYTRYKVRGFVGNSKDLELLIKRYDEEVDAILNVPNDIPHAPTPFCGGFDRCKPHSYIPMNPECHHDVINNIEISSPCQHNKMLDNADISSRHSELGKKRGICHESHHFEFHIDTGKIDLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVTYEQSNYPTDGVPYEQSNYPTDGVPYEQHGCHTDGVPYEQPNYPTDGVPYEQHGCHTDGVPYEQHGCHTDGVPYEQPNYPTDGVPYEQHGCHTDGVPYEQHGCHTDGVPYKQHGCRTDGVPYKQHGCRTDRSRDEQLDYVTKTIDVFPDTDKVRIDIGETEGTFKVESVELIFMEE

SEQ ID NO: 35 - DNA, 3780 bp, Artificial
  A synthetic coding sequence, CR-BREla.TIC7040.nno_Mc:1 encoding a TIC7040 pesticidal protein used for expression in plant cells.
atgaaccagaatcagaatcagaacaagaacgagctacagatcatcgagcctagctccgactcgctcctgtacagccacaacaactacccgtacgcgacggacccgaatactgtgctggagggccgcaactacaaggagtggctcaacaagtgcacggacaactacacggacgccctccaaggcccggaggccacggcgattagcaagggcgcggtctcggcggcaatttcgatctcgactaaggtgctctcgctgctcggcgtgccgtttgcagcgcagatcggccagctctggaccttcatactcaacgcgctctggccgagcgacaacacccagtgggaggagttcatgcgtcacgtcgaggaactgataaaccagcgcatcgcggactacgccaggagcaaggccctcgcggagctgaccgggctcggcaataacctggacttgtacatcgaggcccttgaggactggaaacgaaacccgaccagccaacaagccaaggaccgggtgaaggaccggttccggatcgccgacggcctgttcgaggcgtacatgccttccttccgggtctcgggctatgaagtgccgctcctcacggtgtacgccgcagcggccaacctgcatctcctgctgctaagggattgctcgatctacggcatccagtggggtttctcccagaccaacgtaaacgagaactacaaccgtcagatccggcacacggctgagtacgcaaaccactgcacgacgtggtatcagaccggactggagcggctccgtggcaccaacgcatcttcgtgggttccgtacaaccgtttccgcagagagatgactcttaccgtcctggacatctgctccctcttctccaactatgactacagaagctacccggcggaagtgcgggccgagctaacccgcgaaatctacacggacccggtggtctccacatcgctgtggatgaacaacgcaccatcgttcggtgagatcgagaacctggcaatccgcgctccgcgcacggtgacgtggttgaactcaaccaggatctctaccggcaccctccagggctggtcaggcagtaaccgatactgggcggcacacatgcagaacttcagcgagaccaactccgggaacattggattcgacggcccactgtacggctctaccgtgggcactatcatcagggacgacaactacgagatggtcaacagggacatctacacgattacgtccgaagcggtggccgctctttggcccacagggcagatagtgctgggcgtggcctccgcacgtttcacactccgtaatctcaacaacaatctgacccaggccctggtttacgagaacccgatttcctccagcttcaaccgcagcacgctcacacgggaactacctggcgagaacagtgatcgcccaacgtccagtgactacagccataggctgacatcaatcacggcgttccgggccgggagtaacggcaccatcccggtcttcggctggacctccatctcggtcaaccgggataacatcctggagcgcaacaagataacccagttccctggcgtcaagagccacactctcaacaactgccaagtcgtcagagggaccggcttcactggcggcgactggctcagacccaacaacaacgggtctttccgcctgacgatcaccagcttctcctcgcagtcctaccggataaggctccggtacgcctctgcggccaacacatccctccggatttcttcctccgctgcgggcataagctctacaaccgtgccgctgacctccactattactagccttccgcaaaccgctgtaccctacgaggcgttccgcgtcatcgacctcccgatcaccttcactaccgctacgcagagtaactacaccttcgactttgtcctccagaacccgtccaatgctaacgtcttcatcgaccggttcgagttcgtccctattggaggcagcctttcagagtacgagacgaagcaccagcttgagaaggcgaggaaagctgtcaacgacctgttcacaaacgagagcaagaacgtcctcaagaagtacacgacagattacgacatcgaccaggcggcgaacctggtggagtgcgtctctgacgagtgcgccaacgctaagatgatcctgctggacgaggtgaagtacgcaaagcagctctccgaggcacggaaccttctgctgaacgggaactttgagtaccaggaccgggacggcgagaacccttggaagacttcaccaaacgtaactatccaggagaacaacccgatcttcaagggccgctacctgagcatgagcggcgcgaactacattgaggcaactaacgacacctttcccacctatgcctatcagaagattgatgaagccaaattgaagccgtacacacgctacaaagtgcgtgggttcgtcggcaactccaaggatctggagcttctcattaagcgctacgatgaggaagtggacgctattctcaacgtccctaacgacatcccgcacgcgccgactcctttctgcggaggtttcgaccggtgtaagccgcactcctacatccctatgaacccagagtgtcaccacgacgtcatcaacaacatcgagatcagcagcccatgccagcacaacaagatgctggacaatgcggacatctccagccgtcattctgagctgggcaagaagcgcggcatctgccacgagtcccaccacttcgagttccacattgatacgggcaagattgacctcaacgagaacctcggcatctgggtgatcttcaagatttgcagcacggatggctacgccacgctagacaaccttgaggtgatcgaggagggcccgctcggcgcggaatctctggagcgcgtaaagcgccgggagaagaagtggaagcaccacatggagcacaagtgctccgagacgaaactggcataccacgccgctaagcaagcccttgtgggtctcttcacaaacaccaagtacgaccgacttaagtttgagacgacaatttccaacatcttgttcgccgactacctcgtgcagagcatcccatacgtttacaacaaatggttacccgacgtccctggtatgaactacgacatctacacggagcttaagaacctcttcaccggcgcgttcaacttgtacgatcaacgcaacatcatcaagaacggcgatttcaaccgtggacttatgcactggcacgccacgcctcacgccagagtggagcagatcgacaaccggagtgtcctcgtgttaccgaactacgctgccaacgtctcccaggaggtgtgcctggagcacaaccgtggctacgtcctgcgcgtgacggccaagaaggagggtccgggcatcggctacgtcacgttctccgactgcgccaacaacatcgagaagctgacattcacgtcctgcgactacggcaccaacgaggtgacctacgagcaaagcaactatcacaccgacggcgttccctacgagcagtccaactacccaactgacggcgtaccatacgagcagcacggctgccacaccgacggcgtgccatacgagcagtcgtcctacccgactgacggtgtgccctacgagcagcacggatgccgtacggacggcgtcctgtacaagcagcacggctgtaggacagaccgaagccgcgacgagcagctcgattacgtcaccaagaccattgacgtcttcccggacacggacaaggtccggatcgacatcggagagaccgagggcactttcaaggtcgagtcggttgagctgatcttcatggaggagtga

SEQ ID NO: 36 - DNA, 3888 bp, Artificial
  A synthetic coding sequence, CR-BREla.TIC7040_10.nno_Mc:1 encoding a TIC7040HT pesticidal protein used for expression in plant cells.
atgaaccagaaccagaatcagaacaagaacgagcttcagataatcgagccctcctcggactccctcctctactcgcataacaactacccgtacgctaccgacccgaacaccgtgctggaaggccgcaactacaaggagtggctgaacaagtgtaccgacaactacaccgacgcgctccagggccctgaggccaccgccatcagcaagggcgcggtgtcagccgcgatctccatcagcacaaaggtgctctcgttactgggcgtgcccttcgcggcgcagatcggccagctctggacctttatcctgaacgccctatggcccagcgacaacacccagtgggaggagtttatgcgccacgtggaggaactcattaaccagcgaattgctgactacgccaggagcaaggccctggccgagctgacgggtcttggcaacaacctcgacctctacatcgaggcccttgaagactggaagcggaacccgaccagccaacaggccaaagaccgtgtgaaggaccggttccggatcgccgacgggctgttcgaggcgtacatgccctctttccgcgtcagcggctacgaggtgccactgttgaccgtttacgcggcagccgctaacctccacttgctgctcctgcgggattgctccatctacggtatccagtggggcttcagccagacaaacgtcaacgagaactacaaccgacagatccggcacacggccgagtacgcaaaccactgcacgacatggtatcagacagggcttgaacgccttcgtggcaccaacgcctcgtcatgggtgccgtacaaccggttccgccgagagatgaccctcaccgttcttgacatctgctcactgttcagcaactacgactaccggtcgtaccctgcggaggttcgggccgaactgacgcgggagatctacactgacccggtggtcagcacctcgttgtggatgaacaacgcgcccagcttcggtgagatcgagaacctcgccataagagcaccacgcaccgtcacttggctcaacagcacccggatctccacgggcaccttacagggctggagcggctccaaccgatactgggcagcgcacatgcagaacttctccgagactaactccggcaacatcggcttcgacggcccgctctacggcagcaccgtcgggaccatcatccgggacgacaactatgagatggtcaacagggacatctacacgattacctcggaggccgtggctgccctgtggccaaccggtcaaatagtgttgggagtcgcctccgcccgctttacgctgcgtaacctgaacaacaaccttacccaggcgctcgtgtacgagaacccgatctccagctccttcaataggtccaccctcacgagggagctgccgggtgagaacagcgacaggccgacgtcctcggactacagtcaccggctcacctcgatcacagcgttccgagccgggagcaacggaacgatcccagtcttcggatggaccagcatcagcgtcaaccgcgacaacatcctggaacgcaacaagatcactcagttccctggagttaagtctcacacgctcaacaactgccaagtggtgcgtggcacagggtttaccggaggcgactggcttcgcccgaacaacaatgggtcattccggctgaccattaccagcttctcatcgcaatcataccgcatccggctacggtacgcctcggcggcgaacactagccttcgcatctcctcttcagccgccgggatcagctcgacaaccgtcccgctgaccagcacgatcacgagcctgccacaaactgctgtgccttacgaggctttcagagtgatcgacctgcccattaccttcaccacggcaacccaatcgaactacactttcgacttcgtgttacagaatccgagcaacgccaacgtcttcatcgaccggttcgagttcgtgcccatcggcgggagcctctccgagtacgagaccaaacatcagcttgagaaggcccgcaaggccgtcaatgacctgttcactaacgagtccaagaatgttctcaagaagtacaccacagactacgacatcgaccaagccgcgaacctcgtggagtgcgtgtccgacgagtgcgccaacgcgaagatgatcctgctggacgaggtgaagtacgcgaaacagctcagcgaggcaaggaacctgttgctgaacggaaacttcgagtaccaggaccgggacggtgagaacccgtggaagaccagcccgaacgtgaccatccaggagaacaacccaatcttcaagggccggtatctgtccatgtccggtgctaactacatcgaggcgaccaacgacaccttcccgacgtacgcctaccagaagatcgacgaggccaagctcaagccctacacacggtacaaggttcgcgggttcgtgggcaacagcaaggacttggagctgcttattaagcggtacgacgaggaggtggacgcgatcctgaacgtcccgaacgacataccgcacgcgccgacgccgttctgcggcggctttgaccggtgcaagcctcacagttacattccgatgaacccagagtgccatcacgatgtgattaacaacatcgagataagcagtccgtgccagcacaacaagatgctggacaacgccgacatcagctccagacattcggaactcggcaagaagcgcggaatctgccacgagtcccaccacttcgagttccacatcgacacgggcaagatcgacctgaacgagaacctcgggatttgggtgatcttcaagatctgctctacggacggctacgcgacgctcgacaatctggaggtgatcgaggagggaccgctgggtgctgagagcctggagagagttaaacgtcgggagaagaaatggaaacaccacatggagcacaagtgctccgagacgaaactggcctaccacgcggccaaacaggcgctcgtgggcctgttcacaaacacgaaatacgacaggctcaagttcgagacaaccatctcgaacatcttgttcgccgactacctggtccagtccattccgtatgtgtacaataagtggcttccggacgttcccggcatgaactatgacatctacaccgaacttaagaatctgttcaccggcgcgttcaacctgtacgaccagcgcaacatcattaagaacggtgacttcaatcgagggctgatgcactggcacgccacgcctcacgcccgtgtggagcagatcgacaaccggtccgtgctggtcctgccgaactacgcggcaaacgtcagccaggaagtgtgcttggagcacaatcgcggctacgtgctccgagtgacagccaagaaggagggaccaggaataggctacgtgaccttctccgactgcgcgaacaacatcgagaagctgacctttacaagctgcgactacgggaccaacgaggtcacctacgaacaatccaattaccacactgacggcgtgccgtacgagcagagcaactacccgacggacggcgtgccttacgagcagcacggctgccacacggacggcgtgccgtacgagcagtcgaactacccgaccgacggtgtgccatacgagcagcacggctgccacaccgacggtgtgccctacgagcagcacgggtgccacacggacggtgtgccgtatgagcagcacggctgccacacggacggcgtgccctacaagcagcacgggtgccgcaccgacggcgtactgtacaagcagcacggctgccggactgaccgcagtagggacgagcagctcgattacgtgacgaagaccatcgacgtcttcccggacaccgacaaagtgcgaattgacattggtgagaccgagggcacgttcaaggtcgagtccgtggaactcatcttcatggaggagtga

SEQ ID NO: 37 - DNA, 3888 bp, Artificial
  A synthetic coding sequence, CR-BREla.TIC7040_10.nno_Mc:3 encoding a TIC7040HT pesticidal protein used for expression in plant cells.
atgaaccagaaccagaaccagaacaagaacgagttacagatcatcgagccgtcctcggactccctactttactcgcacaacaactacccgtacgccacggaccccaacacggtgcttgaaggtcgcaactacaaagagtggctcaacaagtgcaccgacaactacacggacgcgctgcaaggcccggaagcgacagccatctcaaagggcgcggtgagcgccgccatctccatctcgacgaaagtgctgtccctgctcggggtgccgttcgcggcgcagatcgggcagctctggacgttcatcctcaacgcgctctggccgtccgacaacacacaatgggaggagttcatgcgccacgtggaggaacttatcaaccagaggatcgccgactacgcgcgcagtaaagccctggcggagttgacgggcctcggcaacaacctggacctgtacatcgaggccctggaagactggaagcggaacccgaccagccaacaagctaaagatcgggtgaaggaccggttccgcatcgccgacggcttgttcgaggcgtacatgccttcgttccgcgtgagcggctacgaggtgcccctcctgacggtttacgccgccgcagccaacttgcacctcctgttgctgagggactgctcgatctacggcatccagtggggcttcagtcagacgaacgtgaacgagaactacaaccgccagatccgccacacggccgagtacgcaaaccattgtacgacgtggtatcagacagggctggaacggctgcgtgggaccaatgcaagtagttgggttccctacaaccggtttcggcgtgagatgacgctgacggtactcgacatctgctcactgttctcaaactacgactaccggagctacccggccgaggtgcgggcggagctgacgagggagatctacactgaccccgttgtcagtacatcgctctggatgaacaacgcgccttccttcggggagatcgagaacctggccatccgggcacctagaacagttacttggctcaacagcacccggatttccaccggcacacttcaaggctggtcgggctccaaccgctactgggcggcccacatgcagaacttctcagagacaaactctgggaacatcgggttcgatggcccgctgtacgggagcaccgtgggcaccatcatccgggacgacaactacgagatggtgaaccgggacatctacaccatcacgtccgaggccgtggccgcattgtggccgactggtcagatcgtactcggcgtcgcgtccgcacgctttactctccgaaacctcaacaacaacctcacccaggccctagtttatgagaaccctatttcctccagcttcaaccgttccacgctgacccgtgagcttccgggcgagaactctgaccggcccacgagcagcgactacagccaccgcctgacgtcaataacagcgttccgcgcgggcagcaacggcaccatccctgtcttcggctggacaagtatcagcgtaaatcgtgacaacatcctggaaaggaacaagataacccagttcccaggcgtgaagtcgcacacactcaacaactgccaagtggtgaggggcacagggttcaccggaggggactggcttcgcccgaacaacaacgggtcattccgactcacaatcacatcgttcagttcacagtcctaccgtatccgtctgcgctacgcgagcgcggcgaacacatccctgcgtatctcctctagcgccgccggaatctccagtaccaccgtgccgctcacgtcaaccatcacctccctcccacagacggcagtcccgtatgaagcgttccgagtgatcgacctcccgatcacgttcaccaccgccacgcagagcaactacacctttgacttcgtgttgcagaacccttcgaacgctaatgtcttcatcgaccggttcgagttcgtccccataggtggttcgctgtctgagtacgagactaaacaccagcttgagaaggcgcgtaaggccgtgaacgacctgttcacgaacgagtccaagaatgtgctcaagaagtacacgactgactacgacattgaccaggccgcgaacctggtggagtgcgtgtcggacgagtgcgcgaacgctaagatgatcctgctcgacgaagtgaagtacgctaagcagcttagcgaggcacgcaacctacttctgaacgggaacttcgagtaccaggaccgtgacggggagaacccctggaagacctccccgaacgtgaccatccaggagaacaacccgatcttcaaggggcgttacctgtccatgagcggggccaactacatcgaggcgacgaacgacaccttccccacgtacgcctaccagaagatagacgaggccaaattgaaaccctacacccggtacaaggttcggggcttcgtgggcaacagcaaggacttggagctgctcatcaagcggtacgacgaggaggtggatgccatcttaaacgtgcccaacgacatcccacacgcgccgacgccgttctgcggcggattcgaccggtgtaaacctcactcgtacatcccgatgaacccagagtgccaccacgacgtcatcaacaacatcgagatcagctcgccttgccagcacaacaagatgctggacaacgcagacatctcctcacggcacagtgaactgggcaagaaacggggaatttgccacgagagccaccacttcgagttccacattgacaccggcaagattgacttgaacgagaacctcgggatctgggtgatcttcaaaatctgctccacggacggctatgctacgttggacaacctggaggtgatcgaggagggcccgctaggagccgagagccttgagcgcgtcaagcggcgcgagaagaagtggaagcaccacatggagcacaagtgcagcgagaccaagctggcttaccacgccgcaaagcaagcgctggttggcctgttcacgaacacaaagtacgaccggctcaagttcgagacgacgatcagcaacatcttgttcgcggattacctggtccagagcatcccatacgtttacaataagtggctccccgacgtccccggcatgaactatgacatctacaccgagcttaagaacctgttcacgggcgctttcaacctttacgaccaacgcaacatcatcaagaacggggacttcaaccggggcttaatgcactggcacgccaccccgcacgcccgcgtggagcagatcgacaaccgcagcgttctcgtgttgccgaactacgccgccaatgtgtcccaggaggtctgccttgagcataaccggggctatgtgctgcgggtcacagccaagaaggaagggccaggaatcggctatgtgaccttcagcgactgcgccaacaacattgagaaactgacgttcacgtcttgcgattacgggaccaacgaggtgacctacgagcagtccaactaccacacggacggggtgccgtacgagcagtccaactacccgactgacggtgtaccatacgagcagcacgggtgccacaccgacggtgtgccatacgagcagtcgaactacccgacggacggcgtgccctacgagcagcacgggtgccacaccgacggcgtgccgtacgagcagcacggctgccacacggacggagtgccctacgagcagcacgggtgccacaccgacggggtgccgtacaagcagcatgggtgccgcacggacggtgtgctgtacaaacagcatggctgtcgtactgaccggtcccgcgacgagcagctagactacgtgacgaagactattgatgtcttcccggacacggacaaggtgcggatcgacatcggggagaccgagggcacgttcaaggtggagtccgtggagcttatcttcatggaggagtag

SEQ ID NO: 38 - DNA, 3888 bp, Artificial
  A synthetic coding sequence, CR-BREla.TIC7040_10.nno_Mc:4 encoding a TIC7040HT pesticidal protein used for expression in plant cells.
atgaaccagaaccagaaccagaacaagaatgagttgcagattatcgagccgtcctccgactccctgctgtactcccacaacaactacccctacgcgacggaccccaatacggtgctagaggggcgcaactacaaggagtggctgaacaagtgcacggacaactacacagacgctttgcaagggccggaggcgaccgccatctcgaaaggagccgtgtcggcggcgatttccatcagcacaaaggtgctgagcctgctcggcgtccccttcgccgcccagatcgggcaactgtggacctttatccttaacgccttgtggccctccgacaacacgcagtgggaggagtttatgcgccacgttgaggagctgattaaccagcgaattgccgactacgcgcgctctaaggcgctggcggaactgaccggcctcgggaacaacctcgacctgtacatcgaggccctggaggactggaagcggaacccaacttcgcaacaagctaaggaccgggtgaaggaccgcttccgcatcgcggacggcctcttcgaagcgtacatgccgtctttccgcgtgagtggctacgaagtgccgctgctgaccgtctatgcagcagcagctaatcttcatctgttgctcctacgcgattgctcaatctacggcatccaatggggcttctcccagacgaatgtgaacgagaactacaacaggcagattcgccacactgcggagtacgcaaaccactgcacgacgtggtatcaaacagggctggagcggctccggggcacgaatgcttcatcgtgggtgccgtacaatcgctttcgtcgtgagatgaccctcacggtgctggacatctgctccctcttcagcaactacgactatcgctcgtacccggccgaggtgcgtgcagaactaactcgggaaatctacacggaccccgtggtcagcacaagcctgtggatgaacaacgcgccgtcgttcggcgagatcgagaacctggcgatccgcgcgccgcgaaccgtcacatggctcaactcgaccaggatctcaaccgggactctacagggctggtccggcagtaaccgctactgggcggctcacatgcagaacttcagcgagacgaactccgggaacatcggcttcgacgggccattgtacggctcaacggtggggaccatcattcgggacgacaactacgagatggtcaaccgggacatctacacgatcacgtccgaggccgtggccgccctgtggccaactgggcagatcgtgctcggggtcgcatcggcgcggttcaccctccgtaacctgaacaacaatttgacacaagcgctggtgtacgagaatccgattagcagctccttcaaccggtccactctgacccgcgagctgcccggcgagaacagcgaccggccgacctccagcgactactcgcacagactcacctccattactgccttccgggcggggtccaacgggaccatcccggtgttcgggtggacctccataagcgtcaaccgagataacatcttggagcgcaacaagattacccagttcccaggagtgaagtcccacaccctcaacaactgccaagttgtgcgcgggacggggttcaccggcggcgactggttgcggcccaacaacaacggcagcttccggctgacgatcacgtccttctccagccagtcgtaccgcatacggctccgttacgccagtgccgccaacacgagccttcgcatcagctcaagcgcagcgggaatctccagcaccactgtcccattgaccagcacgatcacctccctgccccagaccgccgtcccgtacgaggcgttccgcgtgattgatctgcccatcaccttcactaccgctacccaaagtaattacacattcgacttcgtactacagaacccctccaacgctaatgtcttcattgaccgcttcgagttcgtgcccatcggcgggagcctctcggagtacgagacgaagcaccagctcgaaaaggcccgcaaggcggtgaacgacctgttcacgaacgagtccaagaatgtgctcaagaagtacaccactgactatgacattgaccaggctgctaacctggtagagtgcgtgagcgacgagtgcgccaacgcgaagatgatcctgctcgacgaggtgaagtacgccaagcagttgtccgaggcccggaacctgctcctgaacggcaacttcgagtaccaggacagggacggcgagaacccgtggaagacctcgcccaatgtcacgatccaggagaacaatcccatcttcaaggggcggtatctatccatgagcggagcgaactacatcgaggcgaccaacgacaccttccctacctatgcctaccagaagattgacgaggccaagctaaaaccatacacccggtacaaagtgcgcgggttcgtcggcaacagcaaggatctggaactgctcattaagcgctacgacgaggaggtggacgccatcctcaacgtcccgaacgacatcccgcacgcgcccacccctttctgcggcggcttcgaccggtgcaagccgcacagctacatcccgatgaacccagaatgtcaccacgacgtcatcaacaacatcgagatcagcagtccctgccagcacaacaagatgttggacaacgccgacattagcagccgccactcggagcttggcaagaaacgcggaatctgccacgagtcccaccacttcgagtttcacattgacaccgggaagatcgacctgaacgagaacctggggatctgggtgatcttcaagatttgctcgacagatggctacgcgaccctggacaaccttgaggttattgaggaagggccactgggtgcagagtctctggagcgggtcaagcgccgcgagaagaaatggaagcaccacatggagcacaagtgctcggagacgaagctcgcgtaccatgcggcgaaacaggccctggtcgggctcttcaccaacaccaagtacgacaggctcaagttcgagaccaccatctcgaacatcctgttcgccgactacctcgtgcaatccatcccgtatgtttacaacaagtggctcccggacgtgcccggtatgaactacgacatctacaccgaacttaagaatctgttcaccggtgcgttcaacctctacgaccagaggaacatcatcaagaacggggacttcaacagaggactgatgcactggcacgcgacgccgcacgcccgcgtggagcagatcgacaaccgttccgtgctcgtcctcccgaactacgctgcgaacgtaagtcaggaagtctgccttgagcataaccggggctacgtgctccgcgtgacggccaagaaggagggaccagggatcggatacgtgaccttctccgactgcgcgaacaacatcgagaagctgaccttcacaagttgcgactatgggaccaacgaggtcacctacgagcagtcgaactaccacaccgacggagtgccctacgagcaaagcaactaccccaccgacggggtgccctacgagcagcacggctgccatacggacggggttccctacgagcaaagcaactacccgaccgatggcgttccatacgagcagcacgggtgccacaccgacggcgtgccctacgagcagcacggctgccacaccgacggcgtaccttacgaacagcatggctgccacaccgatggggtgccgtacaagcagcacggatgtagaactgacggcgtgctgtacaagcagcacgggtgcagaacagaccgctcaagggatgaacaactcgattacgtgaccaagacaattgacgtcttccctgataccgacaaggtgcgtattgacattggtgagacggagggcaccttcaaggtcgagtccgtggagctgatcttcatggaggagtag

SEQ ID NO: 39 - DNA, 3888 bp, Artificial
  A synthetic coding sequence, CR-BREla.TIC7040_10.nno_Mc:5 encoding a TIC7040HT pesticidal protein used for expression in plant cells.
atgaaccagaaccagaaccagaacaagaacgaactacagatcatcgagccctccagcgactccctcctctacagccacaacaactacccctacgccaccgatcccaacaccgtgctggaagggcgcaactacaaggagtggctcaacaagtgcaccgacaattacacggacgcgcttcaagggccggaggccacagcaatctcgaagggagcggtgagcgccgcgatcagcatctccacgaaagtgctcagtctcctcggggtgccgttcgcggctcagatcggccaactctggaccttcatactcaacgccctgtggcccagcgacaacacgcagtgggaggagttcatgaggcacgtggaggagcttatcaaccagcggatcgccgactacgcgcgaagcaaggctctggcagagctgacgggcctcggcaacaacctggacctctacatcgaggccctggaggactggaaacgcaaccccacaagccaacaagctaaggaccgcgtgaaggaccgcttccgcattgccgacggcctgttcgaagcgtacatgccgagcttccgtgtctcaggctacgaggtgccactcctgacagtgtacgcggcggctgctaacctccacctcctgctgctccgcgattgttcgatctacggaatccagtggggcttctcgcagaccaacgtgaacgagaactacaatcgtcagatccgccacacggcggagtacgcgaaccactgcacaacatggtatcagacgggccttgagcggctgcgaggcaccaacgcgagtagttgggttccatacaaccgcttccgccgcgagatgacgctaaccgtcctcgacatctgttcactgttctcgaactacgactaccgctcctacccggcggaggtccgagcggagctgacacgcgaaatctacacagaccccgttgtgagcactagcctatggatgaacaacgccccttcgttcggcgagatcgagaacctagccatacgcgcccctcgtaccgtgacctggctcaatagtacccggatcagcacaggcactctgcaaggatggtcggggagtaatcggtactgggctgctcacatgcagaacttctccgagaccaactcgggcaacatcggattcgacggtcccctttacggctccaccgtcgggactatcatccgggacgacaactacgagatggtgaaccgcgacatctacaccatcacctccgaggcggtcgccgccctgtggccaactggacagatcgtgctcggcgtggcctcagcccgcttcactctgcggaacctcaacaacaaccttactcaggcgctcgtttatgagaacccgatcagcagctcgttcaaccgcagtaccctgacgagagagctgcctggggagaactccgaccggccgacctctagcgactactcgcatcgtctcacgagcatcacggccttccgagcgggcagcaacggcacgatcccggtgttcggatggacctccattagcgtgaaccgggacaacatcctggaacgcaacaagataacgcaattccccggtgtcaagtcccacacactcaacaactgccaagtggtgcgcggcacggggttcaccggcggggactggcttcggccaaacaacaacggctcgttccggttgactatcaccagcttcagctcccagtcgtaccgtatccgccttcgctacgccagcgcggcgaacacctcccttcgcatcagctcctcggccgccgggatttcgtccaccaccgttcccctgacgtcaacgatcaccagcctgccccagaccgccgtgccgtacgaagcctttcgcgtgatcgaccttccaatcacgttcactacagccactcaatcgaactacacattcgatttcgtcctccagaatccgagcaacgccaacgtcttcatcgaccgattcgagttcgttccaatcggcggtagcctctcggagtacgagaccaaacatcagttggaaaaggcccggaaggcggtgaacgacctcttcacgaatgagagcaagaatgtgctcaagaagtacacaactgattacgacatcgaccaggcggcgaacttggtggagtgcgtgtcggacgagtgcgcgaacgccaagatgatccttctcgacgaggtgaagtatgccaagcaacttagcgaagcccgcaacctcctcctgaacggcaacttcgagtaccaggaccgggacggcgagaacccctggaagaccagtccgaacgtgactatccaggaaaacaatcccatcttcaagggacggtatttgagcatgagtggagcaaactacatcgaggccacaaacgacaccttcccgacctatgcgtaccagaagatcgacgaggccaagctcaagccttacacccggtacaaggtgcgcgggttcgtcgggaacagcaaagaccttgaactactgattaagcgctacgacgaggaggtggatgccatcctgaacgtcccgaacgacattccgcacgccccgacccctttctgtggcggcttcgaccgttgcaagccccactcctacatccccatgaaccctgagtgtcaccacgacgtcatcaacaacatcgaaatctccagcccttgtcagcacaataagatgctggacaacgcagacataagttcccggcatagcgaattgggcaagaagcggggcatctgtcacgagagccaccactttgagttccacatcgacactggcaagatcgacctcaacgagaacctcgggatctgggtgatcttcaagatttgcagtaccgacggctacgcgacgctcgacaaccttgaggtgatcgaggagggcccactcggggccgagagcctggagcgggtgaagcgccgcgagaagaagtggaagcaccacatggagcacaagtgctccgagactaaactggcctaccacgccgccaaacaagccctggtcggcctgtttacaaacaccaaatacgacaggctcaaattcgagacgacaatctcaaacatcctcttcgccgactacctcgtccagagtatcccgtatgtttacaataagtggctgccggacgtccccggcatgaactacgacatctacacggaacttaagaatctgttcacgggtgcattcaacctgtacgaccagaggaacatcattaagaacggggacttcaaccgtggccttatgcactggcacgctacaccccacgcgcgggtcgagcagatagacaaccggtcggtgctcgtgctgccgaactacgccgccaacgtctcacaggaggtctgcctggaacacaaccggggctacgtgctgcgggtgacagccaagaaggagggcccaggaatcggctacgtgacgttctccgactgcgcgaacaacatcgagaaactcacttttacgtcctgcgactacgggactaacgaggtgacgtacgagcagtccaactaccacaccgatggcgtgccctatgagcagtcgaactacccgaccgacggggtgccctacgagcagcacgggtgccacacggacggagtgccctacgagcagtcgaactaccccacggacggcgttccgtacgagcagcacggctgccacacggatggggtgccctacgagcagcacggatgtcacactgatggcgtgccgtacgagcagcacggctgccacaccgacggcgttccctacaagcagcacgggtgcagaacagatggcgtcctctacaaacagcacggttgtcgcacggatcgctcgcgcgatgagcagttggactacgtgaccaagaccatcgacgtattccccgacaccgacaaggtgcggatcgacatcggcgagacggagggcacgttcaaggtcgagtccgtcgagctgatcttcatggaggagtga

SEQ ID NO: 40 - DNA, 3888 bp, Artificial
  A synthetic coding sequence, CR-BREla.TIC7040_10.nno_Mc:6 encoding a TIC7040HT pesticidal protein used for expression in plant cells.
atgaaccagaaccagaaccagaacaagaacgagttgcagatcatcgagccttcctccgatagccttctgtactcgcacaacaactacccctacgccaccgaccccaacacagtcctggaggggcgcaactacaaggagtggctgaacaaatgtaccgacaattacaccgatgctctgcaagggccggaggcgaccgccatctcgaaaggggcggtcagcgccgctattagcataagcacaaaagtcctgtccttgctcggcgtgcccttcgcggcccagatcgggcagctctggacgttcatcctgaacgcgctgtggccgtccgacaacacgcagtgggaggagtttatgcggcacgtcgaggaacttatcaaccagcggatcgccgactacgcgcgctcgaaggcgctcgcagagctgacggggctgggcaacaacctggacctctacatcgaggccctggaggactggaagcggaacccgacgagtcaacaagcgaaagatcgggtgaaggaccggttccggatcgccgacgggctgttcgaggcgtacatgcccagtttccgggtcagcggctacgaggtgcccctgctcaccgtgtacgccgccgccgcgaacctgcacctcctgttgctgagggactgctccatctacggcatccagtggggcttctcccagacaaacgtgaacgaaaactacaacaggcagatccgccacaccgcagagtatgccaaccactgcactacgtggtatcaaacaggactggaacgcctgcggggcaccaatgcttcatcgtgggtgccctacaaccgtttccggcgggagatgaccctgaccgtgttggacatctgttccttgttcagtaattacgactaccggtcttaccctgccgaggtgcgggcagagctgacgcgcgaaatctacacagatcctgtggtgagcacgtcgctgtggatgaacaacgccccgagcttcggcgagatcgagaacctggcgatccgtgcgccgcgcacggtgacgtggctgaactcgacccggatcagcaccggcactctacagggctggtccggcagcaatcgctactgggccgctcacatgcagaatttcagcgagaccaacagcgggaacatcggcttcgacggcccgctctacgggagcaccgtcgggaccatcatccgggacgacaactacgagatggtgaaccgggacatctacacgatcacgtccgaggcggtcgcggctctgtggccaaccgggcaaatagtgctgggcgtggcgtcagcccgtttcaccttgagaaatctgaacaacaacctcacacaggccctcgtgtacgagaacccaatcagcagttcgttcaaccgctcgacgctgacgcgggagctgcccggcgagaactccgaccgcccgaccagctccgactacagccaccgcctcaccagcatcacggcctttcgggccgggtccaacggaaccatccccgtcttcggctggacttctatctctgtcaatcgggataacatccttgagcgcaacaagatcactcaattccctggagtcaagtctcacacgctcaacaactgccaagtcgttagaggcaccggcttcacaggaggcgactggctccgccccaacaacaatggctccttccgcctgaccatcacgtcattcagtagtcagtcgtatcgcatccggcttcggtacgccagcgcagcgaacacgagtctcaggatctcatctagtgccgctggcatctccagcaccacagtccctctgacgtccaccatcacctcccttccccaaacggcggtcccctacgaggctttccgtgtaattgaccttcccatcacctttaccaccgccacgcagagcaactacactttcgatttcgtactccaaaatccgagcaacgcgaatgtcttcatcgaccggttcgagttcgtccccatcggcggcagcctcagcgagtacgagacgaaacatcagcttgaaaaggcacgcaaggcggtcaacgacctgttcaccaacgagagcaagaatgtgctcaagaagtacaccacagactacgacatcgaccaggctgctaacctggttgagtgcgtgagcgacgagtgcgccaacgccaagatgatcctattagacgaagttaagtacgccaagcagctaagtgaggcgcgaaacctgttgctcaacggcaacttcgagtaccaggaccgggacggggagaacccgtggaagaccagcccaaacgtgacgatccaggagaacaaccccatcttcaaaggacgatacctaagtatgagcggggctaactacatcgaggcgacgaacgatacttttcccacttatgcctaccagaagatcgacgaggccaagctcaagccctacacacggtacaaagtgcggggcttcgtcggaaattcgaaagaccttgaattacttattaagcgctacgacgaggaggtggacgctatcctgaacgtgcccaacgacatcccgcacgccccgacgccattctgcggcggtttcgaccggtgcaagccgcattcgtacataccgatgaacccggagtgccaccacgacgtgataaacaacatcgagatcagtagcccgtgccagcacaacaagatgctggacaacgccgacatcagctcccgtcactcggaactgggcaagaagcgtggaatctgccacgagtctcaccacttcgagttccacatcgacaccggcaagatcgacctaaacgagaacctggggatctgggtgatcttcaagatttgctcaacagacggatacgcgaccctggacaacctggaggtgattgaggaaggcccgctcggggcggagtcccttgaaagagttaagaggcgggagaagaagtggaagcaccacatggagcacaagtgctccgagacgaagctggcgtaccacgcagccaaacaggcgctcgttggcctgttcaccaacaccaagtacgaccggctcaagttcgagaccacaatctcgaacatcctgttcgccgactacctcgtgcagagcatcccttacgtttacaacaaatggctccccgacgtgcccggcatgaactacgacatctacaccgaacttaagaacctgtttaccggggccttcaacctgtacgatcagaggaacattatcaagaacggcgacttcaacaggggcctcatgcactggcacgcgacgccccacgcccgagtggagcagatcgacaaccgttctgtgctggtcctacccaactacgcggccaacgtcagccaagaggtgtgcctggagcacaaccggggttacgtgctgcgagtgacggccaagaaggaaggtccagggatcggctatgtgacgttctcggactgcgccaacaacatcgagaagctcacgttcacgtcctgcgactacggcaccaacgaggttacttacgagcaaagcaattaccatacggacggcgttccgtatgaacagtcaaactacccgacggacggcgtgccctacgagcagcacgggtgccacaccgacggcgtgccctacgagcagagcaactaccccaccgacggcgtgccgtacgagcagcacggctgccacaccgacggagtgccgtacgagcagcacggctgccacaccgacggcgtgccgtacgagcagcacgggtgccataccgacggcgtgccgtacaagcagcacggctgccgcaccgacggggtgctgtacaagcagcacggttgccgcacagatcggagccgtgacgagcagctcgattacgtgacgaagaccatcgacgttttcccggacaccgacaaggttcgtattgacatcggcgaaacggaagggacattcaaggtggagtccgtcgagctaatcttcatggaggagtag

SEQ ID NO: 41 - DNA, 3888 bp, Artificial
  A synthetic coding sequence, CR-BREla.TIC7040_10.nno_Mc:7 encoding a TIC7040HT pesticidal protein used for expression in plant cells.
atgaaccagaaccagaaccagaacaagaacgagcttcagatcatcgagccgtcctccgacagcctgctctacagccacaacaattacccctatgccaccgacccgaacaccgtgctggaggggcgcaactacaaggagtggctgaacaagtgcaccgacaactacacggacgcgctccagggccccgaggccaccgcgatcagcaaaggggccgtgtcggcggcgatctccatcagcacgaaagtgctgagcctgctcggggtgccattcgcggcccagatcgggcagctctggacgttcatcctcaacgccctgtggccgtccgacaacacccagtgggaggagttcatgcggcacgtcgaggaacttattaaccagaggatcgcggactacgcgcgctcgaaggccctcgcggagctaaccgggctgggcaacaacctggacctctacattgaggcccttgaggactggaagcgtaacccaacgtcgcaacaggcgaaggaccgcgtgaaggaccggttccgtatcgccgacggactgttcgaggcgtacatgccgagcttccgcgtctcaggctacgaagtgcctttgctcaccgtctatgcggcggcggcgaacctccacctccttctgctccgggactgctcgatctacggtatccaatggggcttctcccagacaaacgtgaatgagaactacaatcgtcagatccggcacaccgcagagtacgcgaaccactgcacaacctggtatcagactgggttggagcggctccgagggacgaatgcctcatcctgggtgccgtacaaccgtttccggcgtgagatgacattaacggtccttgacatctgttccctgttcagcaattacgattaccgcagttacccggcggaggtccgggcggagttgacgcgcgaaatctacacagacccagtggtcagcacttccctctggatgaacaacgctccgagcttcggcgagatcgagaacctggccatccgggccccgcgcacggtgacgtggctcaactcaacccggatctccacaggcacgctacaggggtggtctggtagtaatcgctactgggcggcgcacatgcagaacttcagcgagacgaacagcgggaacatcgggttcgacggcccgctctacgggtccaccgtgggcaccataatcagggatgataactacgagatggtcaaccgggacatctacaccatcaccagcgaggccgtggccgccctgtggccgacagggcagatagtgctcggcgtggcgagcgcccgctttaccctgcggaacctcaacaataacctgacccaggctctagtgtacgagaacccaatcagctccagtttcaaccgaagtaccttgacgagggaactgccgggcgagaactctgaccgtcccacgtcgagcgactacagccacagacttacctctattacggccttccgtgcgggcagcaacggtacgatcccggtcttcgggtggaccagcataagcgtgaatcgggacaacatcctggaacgcaacaagatcacccagtttcctggcgtgaagtcacacacactgaacaactgccaagtcgtgaggggcaccggcttcacgggcggggactggctccgcccgaacaacaatggctcctttcgcctcacaatcacctccttctcgtcgcagagctaccggatcaggctccggtacgcttccgccgcaaatacttcactacgcatcagctcctcggccgccggaatctcctctactactgtgccattgacttcgacgatcaccagcctcccgcagacagcggtgccctacgaagcgttccgcgtcatcgacctccctatcactttcacgaccgcgacgcagagtaactacacattcgacttcgtactccagaacccgtccaacgcgaacgtcttcattgatcggtttgagttcgtgccaataggcgggtcactcagcgagtacgagacgaagcaccaattggaaaaggctcggaaagctgtgaatgatctgtttacaaacgaaagcaagaatgtgctcaagaagtacactactgattacgacatcgaccaagccgccaacctcgtggagtgcgtctccgacgagtgcgccaacgcaaagatgatcctgctcgatgaggtgaagtacgccaaacaactaagcgaggcacgcaatctcctcctcaacggcaacttcgagtaccaggaccgggacggggagaacccctggaagacctcgccgaacgtgaccatccaggagaacaaccccatcttcaaggggagatacttgagcatgagcggggctaactacatcgaggccaccaacgacaccttcccgacctacgcttaccagaaaatcgacgaggccaaattgaagccctacacgcgatacaaggtgcgcggcttcgtcgggaacagcaaagaccttgagctgctcatcaagcggtacgacgaggaggtggatgcgatcctcaacgtcccgaacgacatcccgcacgcgcccaccccgttctgcggcggcttcgaccgttgcaagccccactcctacattccgatgaacccggaatgtcatcacgatgtcattaacaacattgaaatcagcagcccgtgccagcataacaagatgctggacaacgcggacatctcatcccgccacagtgaacttggcaagaaacgcgggatctgccacgagtcccaccacttcgagttccacatcgacacggggaagatcgacttgaacgagaatctcgggatctgggtgatcttcaagatttgcagtacggacggctacgccacgctcgacaacctggaggttatcgaggaggggccgctcggagccgagtccctggagcgcgtcaaacgccgcgagaagaagtggaagcaccacatggagcacaagtgcagcgagacgaagctcgcctaccacgcagctaaacaagctctggtgggcctgttcaccaacacgaagtacgaccggctcaagttcgagaccacgatcagcaacatcctgttcgcggactacctggtgcagtcaataccgtatgtgtacaacaaatggctcccggacgtgcccggcatgaactacgacatctacaccgaacttaagaacctattcacaggagcattcaacctgtacgaccagcgaaacattatcaagaacggcgacttcaataggggcctgatgcactggcacgccactccccacgcaagggtcgagcaaatagacaaccggagcgtgctcgttctaccgaattacgccgccaatgtaagccaggaggtctgccttgagcacaaccgtggttacgtcttgcgggtgacggccaagaaggaagggccagggatcggctacgtgacgttctccgactgcgccaacaacatcgagaagctcacttttacctcctgcgactacggcacaaacgaggtcacttacgagcagtcgaactaccacaccgatggcgttccgtacgaacaaagcaactaccccaccgacggagtgccctacgagcagcacggctgccacacagacggcgtgccgtacgagcagtcaaactacccgacggacggcgtgccctacgagcagcacgggtgccacacggacggcgtgccttacgagcagcacgggtgccacacggacggggtgccctacgagcagcacggctgccacacggacggcgtgccgtacaagcagcacggctgccgcacggatggcgtgctgtacaagcagcacggatgtagaacagatcggtcccgcgacgagcaactggactatgttaccaagacaatagacgtcttcccggacaccgacaaggtgcggattgacatcggggagactgagggcacgttcaaggtcgagtccgtggagctgatcttcatggaggagtga

SEQ ID NO: 42 - DNA, 1923 bp, Artificial
  A synthetic coding sequence used for expression in plant cells, CR-BREla.TIC7040_1.nno_Mc:1 which encodes a protein having an N-terminal and C-terminal truncation relative to the TIC7040HT protein.
atgcagatcatcgagcctagctccgactcgctcctgtacagccacaacaactacccgtacgcgacggacccgaatactgtgctggagggccgcaactacaaggagtggctcaacaagtgcacggacaactacacggacgccctccaaggcccggaggccacggcgattagcaagggcgcggtctcggcggcaatttcgatctcgactaaggtgctctcgctgctcggcgtgccgtttgcagcgcagatcggccagctctggaccttcatactcaacgcgctctggccgagcgacaacacccagtgggaggagttcatgcgtcacgtcgaggaactgataaaccagcgcatcgcggactacgccaggagcaaggccctcgcggagctgaccgggctcggcaataacctggacttgtacatcgaggcccttgaggactggaaacgaaacccgaccagccaacaagccaaggaccgggtgaaggaccggttccggatcgccgacggcctgttcgaggcgtacatgccttccttccgggtctcgggctatgaagtgccgctcctcacggtgtacgccgcagcggccaacctgcatctcctgctgctaagggattgctcgatctacggcatccagtggggtttctcccagaccaacgtaaacgagaactacaaccgtcagatccggcacacggctgagtacgcaaaccactgcacgacgtggtatcagaccggactggagcggctccgtggcaccaacgcatcttcgtgggttccgtacaaccgtttccgcagagagatgactcttaccgtcctggacatctgctccctcttctccaactatgactacagaagctacccggcggaagtgcgggccgagctaacccgcgaaatctacacggacccggtggtctccacatcgctgtggatgaacaacgcaccatcgttcggtgagatcgagaacctggcaatccgcgctccgcgcacggtgacgtggttgaactcaaccaggatctctaccggcaccctccagggctggtcaggcagtaaccgatactgggcggcacacatgcagaacttcagcgagaccaactccgggaacattggattcgacggcccactgtacggctctaccgtgggcactatcatcagggacgacaactacgagatggtcaacagggacatctacacgattacgtccgaagcggtggccgctctttggcccacagggcagatagtgctgggcgtggcctccgcacgtttcacactccgtaatctcaacaacaatctgacccaggccctggtttacgagaacccgatttcctccagcttcaaccgcagcacgctcacacgggaactacctggcgagaacagtgatcgcccaacgtccagtgactacagccataggctgacatcaatcacggcgttccgggccgggagtaacggcaccatcccggtcttcggctggacctccatctcggtcaaccgggataacatcctggagcgcaacaagataacccagttccctggcgtcaagagccacactctcaacaactgccaagtcgtcagagggaccggcttcactggcggcgactggctcagacccaacaacaacgggtctttccgcctgacgatcaccagcttctcctcgcagtcctaccggataaggctccggtacgcctctgcggccaacacatccctccggatttcttcctccgctgcgggcataagctctacaaccgtgccgctgacctccactattactagccttccgcaaaccgctgtaccctacgaggcgttccgcgtcatcgacctcccgatcaccttcactaccgctacgcagagtaactacaccttcgactttgtcctccagaacccgtccaatgctaacgtcttcatcgaccggttcgagttcgtccctattggatga

SEQ ID NO: 43 - protein, 640 aa, Artificial
  The amino acid sequence of the CR-BREla.TIC7040_1.nno_Mc:1 protein, comprising amino acids 15 through 651 of TIC7040HT.
MQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIG

SEQ ID NO: 44 - DNA, 1983 bp, Artificial
  A synthetic coding sequence used for expression in plant cells, CR-BREla.TIC7040_2.nno_Mc:1 encoding a TIC7040_6 (SEQ ID NO:10) pesticidal protein sequence which comprises an N-terminal and C-terminal truncation relative to the TIC7040HT protein.
atgcagatcatcgagcctagctccgactcgctcctgtacagccacaacaactacccgtacgcgacggacccgaatactgtgctggagggccgcaactacaaggagtggctcaacaagtgcacggacaactacacggacgccctccaaggcccggaggccacggcgattagcaagggcgcggtctcggcggcaatttcgatctcgactaaggtgctctcgctgctcggcgtgccgtttgcagcgcagatcggccagctctggaccttcatactcaacgcgctctggccgagcgacaacacccagtgggaggagttcatgcgtcacgtcgaggaactgataaaccagcgcatcgcggactacgccaggagcaaggccctcgcggagctgaccgggctcggcaataacctggacttgtacatcgaggcccttgaggactggaaacgaaacccgaccagccaacaagccaaggaccgggtgaaggaccggttccggatcgccgacggcctgttcgaggcgtacatgccttccttccgggtctcgggctatgaagtgccgctcctcacggtgtacgccgcagcggccaacctgcatctcctgctgctaagggattgctcgatctacggcatccagtggggtttctcccagaccaacgtaaacgagaactacaaccgtcagatccggcacacggctgagtacgcaaaccactgcacgacgtggtatcagaccggactggagcggctccgtggcaccaacgcatcttcgtgggttccgtacaaccgtttccgcagagagatgactcttaccgtcctggacatctgctccctcttctccaactatgactacagaagctacccggcggaagtgcgggccgagctaacccgcgaaatctacacggacccggtggtctccacatcgctgtggatgaacaacgcaccatcgttcggtgagatcgagaacctggcaatccgcgctccgcgcacggtgacgtggttgaactcaaccaggatctctaccggcaccctccagggctggtcaggcagtaaccgatactgggcggcacacatgcagaacttcagcgagaccaactccgggaacattggattcgacggcccactgtacggctctaccgtgggcactatcatcagggacgacaactacgagatggtcaacagggacatctacacgattacgtccgaagcggtggccgctctttggcccacagggcagatagtgctgggcgtggcctccgcacgtttcacactccgtaatctcaacaacaatctgacccaggccctggtttacgagaacccgatttcctccagcttcaaccgcagcacgctcacacgggaactacctggcgagaacagtgatcgcccaacgtccagtgactacagccataggctgacatcaatcacggcgttccgggccgggagtaacggcaccatcccggtcttcggctggacctccatctcggtcaaccgggataacatcctggagcgcaacaagataacccagttccctggcgtcaagagccacactctcaacaactgccaagtcgtcagagggaccggcttcactggcggcgactggctcagacccaacaacaacgggtctttccgcctgacgatcaccagcttctcctcgcagtcctaccggataaggctccggtacgcctctgcggccaacacatccctccggatttcttcctccgctgcgggcataagctctacaaccgtgccgctgacctccactattactagccttccgcaaaccgctgtaccctacgaggcgttccgcgtcatcgacctcccgatcaccttcactaccgctacgcagagtaactacaccttcgactttgtcctccagaacccgtccaatgctaacgtcttcatcgaccggttcgagttcgtccctattggaggcagcctttcagagtacgagacgaagcaccagcttgagaaggcgaggaaagctgtcaactga

SEQ ID NO: 45 - DNA, 1752 bp, Artificial
  A synthetic coding sequence used for expression in plant cells, CR-BREla.TIC7040_11.nno_Mc:1 which encodes a protein having an N-terminal and C-terminal truncation relative to the TIC7040HT protein.
atgaactacaaggagtggctgaacaagtgtaccgacaactacaccgacgcgctccagggccctgaggccaccgccatcagcaagggcgcggtgtcagccgcgatctccatcagcacaaaggtgctctcgttactgggcgtgcccttcgcggcgcagatcggccagctctggacctttatcctgaacgccctatggcccagcgacaacacccagtgggaggagtttatgcgccacgtggaggaactcattaaccagcgaattgctgactacgccaggagcaaggccctggccgagctgacgggtcttggcaacaacctcgacctctacatcgaggcccttgaagactggaagcggaacccgaccagccaacaggccaaagaccgtgtgaaggaccggttccggatcgccgacgggctgttcgaggcgtacatgccctctttccgcgtcagcggctacgaggtgccactgttgaccgtttacgcggcagccgctaacctccacttgctgctcctgcgggattgctccatctacggtatccagtggggcttcagccagacaaacgtcaacgagaactacaaccgacagatccggcacacggccgagtacgcaaaccactgcacgacatggtatcagacagggcttgaacgccttcgtggcaccaacgcctcgtcatgggtgccgtacaaccggttccgccgagagatgaccctcaccgttcttgacatctgctcactgttcagcaactacgactaccggtcgtaccctgcggaggttcgggccgaactgacgcgggagatctacactgacccggtggtcagcacctcgttgtggatgaacaacgcgcccagcttcggtgagatcgagaacctcgccataagagcaccacgcaccgtcacttggctcaacagcacccggatctccacgggcaccttacagggctggagcggctccaaccgatactgggcagcgcacatgcagaacttctccgagactaactccggcaacatcggcttcgacggcccgctctacggcagcaccgtcgggaccatcatccgggacgacaactatgagatggtcaacagggacatctacacgattacctcggaggccgtggctgccctgtggccaaccggtcaaatagtgttgggagtcgcctccgcccgctttacgctgcgtaacctgaacaacaaccttacccaggcgctcgtgtacgagaacccgatctccagctccttcaataggtccaccctcacgagggagctgccgggtgagaacagcgacaggccgacgtcctcggactacagtcaccggctcacctcgatcacagcgttccgagccgggagcaacggaacgatcccagtcttcggatggaccagcatcagcgtcaaccgcgacaacatcctggaacgcaacaagatcactcagttccctggagttaagtctcacacgctcaacaactgccaagtggtgcgtggcacagggtttaccggaggcgactggcttcgcccgaacaacaatgggtcattccggctgaccattaccagcttctcatcgcaatcataccgcatccggctacggtacgcctcggcggcgaacactagccttcgcatctcctcttcagccgccgggatcagctcgacaaccgtcccgctgaccagcacgatcacgagcctgccacaaactgctgtgccttacgaggctttcagagtgatcgacctgcccattaccttcaccacggcaacccaatcgtga

SEQ ID NO: 46 - protein, 583 aa, Artificial
  The amino acid sequence of the CR-BREla.TIC7040_11.nno_Mc:1 protein, comprising amino acids 14 through 671 of TIC7040HT.
MNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQS

SEQ ID NO: 47 - DNA, 1983 bp, Artificial
  A synthetic coding sequence used for expression in plant cells, CR-BREla.TIC7040_12.nno_Mc:2 which encodes a protein having a C-terminal truncation relative to the TIC7040HT protein.
atgaaccagaaccagaatcagaacaagaacgagcttcagataatcgagccctcctcggactccctcctctactcgcataacaactacccgtacgctaccgacccgaacaccgtgctggaaggccgcaactacaaggagtggctgaacaagtgtaccgacaactacaccgacgcgctccagggccctgaggccaccgccatcagcaagggcgcggtgtcagccgcgatctccatcagcacaaaggtgctctcgttactgggcgtgcccttcgcggcgcagatcggccagctctggacctttatcctgaacgccctatggcccagcgacaacacccagtgggaggagtttatgcgccacgtggaggaactcattaaccagcgaattgctgactacgccaggagcaaggccctggccgagctgacgggtcttggcaacaacctcgacctctacatcgaggcccttgaagactggaagcggaacccgaccagccaacaggccaaagaccgtgtgaaggaccggttccggatcgccgacgggctgttcgaggcgtacatgccctctttccgcgtcagcggctacgaggtgccactgttgaccgtttacgcggcagccgctaacctccacttgctgctcctgcgggattgctccatctacggtatccagtggggcttcagccagacaaacgtcaacgagaactacaaccgacagatccggcacacggccgagtacgcaaaccactgcacgacatggtatcagacagggcttgaacgccttcgtggcaccaacgcctcgtcatgggtgccgtacaaccggttccgccgagagatgaccctcaccgttcttgacatctgctcactgttcagcaactacgactaccggtcgtaccctgcggaggttcgggccgaactgacgcgggagatctacactgacccggtggtcagcacctcgttgtggatgaacaacgcgcccagcttcggtgagatcgagaacctcgccataagagcaccacgcaccgtcacttggctcaacagcacccggatctccacgggcaccttacagggctggagcggctccaaccgatactgggcagcgcacatgcagaacttctccgagactaactccggcaacatcggcttcgacggcccgctctacggcagcaccgtcgggaccatcatccgggacgacaactatgagatggtcaacagggacatctacacgattacctcggaggccgtggctgccctgtggccaaccggtcaaatagtgttgggagtcgcctccgcccgctttacgctgcgtaacctgaacaacaaccttacccaggcgctcgtgtacgagaacccgatctccagctccttcaataggtccaccctcacgagggagctgccgggtgagaacagcgacaggccgacgtcctcggactacagtcaccggctcacctcgatcacagcgttccgagccgggagcaacggaacgatcccagtcttcggatggaccagcatcagcgtcaaccgcgacaacatcctggaacgcaacaagatcactcagttccctggagttaagtctcacacgctcaacaactgccaagtggtgcgtggcacagggtttaccggaggcgactggcttcgcccgaacaacaatgggtcattccggctgaccattaccagcttctcatcgcaatcataccgcatccggctacggtacgcctcggcggcgaacactagccttcgcatctcctcttcagccgccgggatcagctcgacaaccgtcccgctgaccagcacgatcacgagcctgccacaaactgctgtgccttacgaggctttcagagtgatcgacctgcccattaccttcaccacggcaacccaatcgaactacactttcgacttcgtgttacagaatccgagcaacgccaacgtcttcatcgaccggttcgagttcgtgcccatcggcgggagcctctccgagtacgagaccaagtga

SEQ ID NO: 48 - protein, 660 aa, Artificial
  The amino acid sequence of the CR-BREla.TIC7040_12.nno_Mc:2 protein, consisting of amino acids 1 through 660 of TIC7040HT.
MNQNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIGGSLSEYETK

SEQ ID NO: 49 - DNA, 1875 bp, Artificial
  A synthetic coding sequence used for expression in plant cells, CR-BREla.TIC7040_13.nno_Mc:1 which encodes a protein having a C-terminal truncation relative to the TIC7040HT protein.
atgaaccagaaccagaatcagaacaagaacgagcttcagataatcgagccctcctcggactccctcctctactcgcataacaactacccgtacgctaccgacccgaacaccgtgctggaaggccgcaactacaaggagtggctgaacaagtgtaccgacaactacaccgacgcgctccagggccctgaggccaccgccatcagcaagggcgcggtgtcagccgcgatctccatcagcacaaaggtgctctcgttactgggcgtgcccttcgcggcgcagatcggccagctctggacctttatcctgaacgccctatggcccagcgacaacacccagtgggaggagtttatgcgccacgtggaggaactcattaaccagcgaattgctgactacgccaggagcaaggccctggccgagctgacgggtcttggcaacaacctcgacctctacatcgaggcccttgaagactggaagcggaacccgaccagccaacaggccaaagaccgtgtgaaggaccggttccggatcgccgacgggctgttcgaggcgtacatgccctctttccgcgtcagcggctacgaggtgccactgttgaccgtttacgcggcagccgctaacctccacttgctgctcctgcgggattgctccatctacggtatccagtggggcttcagccagacaaacgtcaacgagaactacaaccgacagatccggcacacggccgagtacgcaaaccactgcacgacatggtatcagacagggcttgaacgccttcgtggcaccaacgcctcgtcatgggtgccgtacaaccggttccgccgagagatgaccctcaccgttcttgacatctgctcactgttcagcaactacgactaccggtcgtaccctgcggaggttcgggccgaactgacgcgggagatctacactgacccggtggtcagcacctcgttgtggatgaacaacgcgcccagcttcggtgagatcgagaacctcgccataagagcaccacgcaccgtcacttggctcaacagcacccggatctccacgggcaccttacagggctggagcggctccaaccgatactgggcagcgcacatgcagaacttctccgagactaactccggcaacatcggcttcgacggcccgctctacggcagcaccgtcgggaccatcatccgggacgacaactatgagatggtcaacagggacatctacacgattacctcggaggccgtggctgccctgtggccaaccggtcaaatagtgttgggagtcgcctccgcccgctttacgctgcgtaacctgaacaacaaccttacccaggcgctcgtgtacgagaacccgatctccagctccttcaataggtccaccctcacgagggagctgccgggtgagaacagcgacaggccgacgtcctcggactacagtcaccggctcacctcgatcacagcgttccgagccgggagcaacggaacgatcccagtcttcggatggaccagcatcagcgtcaaccgcgacaacatcctggaacgcaacaagatcactcagttccctggagttaagtctcacacgctcaacaactgccaagtggtgcgtggcacagggtttaccggaggcgactggcttcgcccgaacaacaatgggtcattccggctgaccattaccagcttctcatcgcaatcataccgcatccggctacggtacgcctcggcggcgaacactagccttcgcatctcctcttcagccgccgggatcagctcgacaaccgtcccgctgaccagcacgatcacgagcctgccacaaactgctgtgccttacgaggctttcagagtgatcgacctgcccattaccttcaccacggcaacccaatcgtga

SEQ ID NO: 50 - protein, 624 aa, Artificial
  The amino acid sequence of the CR-BREla.TIC7040_13.nno_Mc:1 protein, consisting of amino acids 1 through 627 of TIC7040HT.
MNQNQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQS

SEQ ID NO: 51 - DNA, 3801 bp, Artificial
  A synthetic coding sequence used for expression in plant cells, CR-BREla.TIC7042.nno_Mc:1 which encodes a TIC7042 protein (SEQ ID NO:12).
atgaatcagaaccagaacaagaacgagatgcagatcatcgagccgtcgagcgactccttcctctattcccacaacaactacccgtacgccactgacccggacacgatcctcaagggccggaactacaaggagtggctcaacatgtgcaccgatacggacgactcgcgctcgcccgaggccgcgagcacggctcgcagcgcgatctccgtcgccatcaccattagcaccaccatcctgggactccttggagttcccttcgcgtcccagatcggtgccttctacaacttcgtgctcaacaccgtgtggcctcagggaaataaccagtgggaggagttcatgaggcacgtggagaacctcatcaacgagcgcattgctgactacgcgcgcgacaaagccttggccgagctgaccggcctgggcaacaacctgaatctctatcgggaggctttcgaggactggcggcggaacccgacctcccaggaagccaagactcgggtgatcgaccgctttcgtattctcgacggcctgttcgagacttacatgccctccttcgcggtccgcaactttgaggttcagctcctgactgtgtacgcctcggctgcaaacatacacctgttcctgctgcgggacagctcgatctacggtttggactggggcctgtcacagaccaacgtgaacgagaactacaaccggcagatccgccacgccgccacctatgcaaaccactgcaccacttggtatcagacagggctccagcgcctccagggcactaacgcaacgtcatgggttgcatacaaccggtttcggcgggagatgacactcaccgtgttggacatctgctcgctgttctccaactacgactaccggtcgtacccgactgaggtgaagggcgagttgaccagggaaatctacacagaccctgtcggccggaactggcagaacgtcgcgccttcattcgcggagattgagaacctgaccattcgcgctccgcgtaccgtcacttggctcaactccactcggatcttcacagggacgctgaccggctggtccgggtccaaccgctactgggccgcccacatgcagaacttcagcgagacaaactctggcaacatcggattcgatggcccacagtatgggtccacggtcgggacgatacaccggaccgacgactacgacatggtgaaccgggacatctacaccataacgagccaggcagtcgccgccctctggcccaccggccagacagtcctgggcgtggcgagcacccgcttcacactgaggaatctgaacaacaactcgacggaggcactcgtgtacgagaacgccatctcgtcctccttcgttagcagcactctcactcatgagctgccgggcgagaacagcgaccgcccaacgagcagcgattacagccaccgtctttcctccatcacgggcttccgggctggagccaacgggaccgtgcccgtgttcggttggaccagcgcgacagttgaccgtaacaacatcatcgagcagaacaagatcacccagttccctggcgttaagtcacacactcttaacaactgtcaagtggtgcgtggcaccgggttcaccggcggcgactggcttcgcccaaacaacaatggcacctttcggctgaccattaccagcttctcgtcccagtcctaccgcatcaggcttcgatacgctaccagcgtcggcaacacctctcttgtcatctcgtcatccgacgcgggcatctccagtaccacaatccctctgacatccaccatcacgtcgctcccgcagaccgttccgtaccaggcgttccgcgtcgtcgatctcccgatcactttcactactccgaccactcagcgcaattacaccttcgatttccgcctccagaacccgagcaacgctaacgtattcatcgaccgcttcgagttcgtaccaatcggcggctcactgtccgagtacgagacgaagcaccaactggagaaggctcgcaaggcagtgaacgacctcttcactaacgagagcaagaacgtgctcaagaaggacacgacggattacgacattgaccaggcggcgaatctggtggaatgcgtgtctgacgagtgcgccaacgcgaagatgatactcctcgatgaggttaagtacgccaaacagctcagcgaggctcgaaacctccttcttaatggcaactttgaataccaagaccgtgacggcgagaacccgtggaagacctcgccaaacgtcaccatccaggagaacaatccgatcttcaagggccgctaccttagcatgtccggcgcaaacaacatcgaggccaccaacgaaatcttcccaacttatgtttatcagaagatcgacgagtcaaagctaaagccatacacccgctacaaggtgcgcggctttgtgggcaactccaaggatctcgaactgctggtcactcgttacgacgaggaggtggacgcgatactgaatgtctccaatgacataccgcacgcgccaccgccattctgcggcgagttcgaccgctgcaagccacactcctaccctcctattaacccggagtgccaccacgacgtcattaacaacatcgaaatctctagcccatgccagcacaacaagatggtggacagcgcggacatcagttaccggcatagccggatcagtaagaagcacggcatctgtcatgaatcacaccacttcgagttccacattgacaccggcaagatagacctggtcgagaacctgggcatctgggtgatcttcaagatttgcagcacggatggctacgcgactctcgacaatctggaggtcatcgaggagggcccactcggagccgagtccctagagcgcgttaagcggcgcgagaagaagtggaagcaccacatggagcacaagtgctcggagacgaagcacgcataccatgcagcgaagcaagcggtggtggcactcttcaccaattccaagtacgataggctcaagttcgaaaccaccatctcgaacatcctgttcgcggactacctcgttcagtcaatcccgtacgtttacaataagtggctgcccggtgtgccgggcatgaactacgacatctacaccgaactaaagaacctgttcacgggcgcattcaacctttacgatcagcggaacatcatcaagaacggcgatttcaaccgtggcctcatgcactggcacgctacgccgcacgctcgggtggagcagatcatcgacaaccggtcagtcctggtcctgcccaactatgcggccaatgtttctcaggaggtgtgccttgagcacaatcgcgggtatgttctccgggtgacagccaagaaggagggccctggcatcgggtacgtcaccttctccgactgcgccaaccacatcgagaaacttacgtttacgagctgcgactatggcaccaacgtggtcccgtacgagcagtcaaattaccctacagacggcgtgccgtacgggcagcacggctgcaacatcgacggcgtcccgtacgagcaaagcggctaccgcaccgacggcgtcccgtacgagctgggccaccgcaccgacggcgtaccgtacgagcagagcggataccgcaccgacggcgtgccctgcgagcagcacggttgtcacaccgacgggctgccgcacatccagcacggctgccgcacggaccgctccagagacgagctgttgggctacgtcaccaagactattgatgtgttcccgaacacggacaaggtgcggatcgacattggcgagaccgagggaaccttcaaggtggagtccgtggaactgatctgcatggaggagtag

SEQ ID NO: 52 - DNA, 1914 bp, Artificial
  A synthetic coding sequence used for expression in plant cells, CR-BREla.TIC7042_1.nno_Mc:1 which encodes a protein having an N-terminal and C-terminal truncation relative to the TIC7042 protein.
atgcagatcatcgagccgtcgagcgactccttcctctattcccacaacaactacccgtacgccactgacccggacacgatcctcaagggccggaactacaaggagtggctcaacatgtgcaccgatacggacgactcgcgctcgcccgaggccgcgagcacggctcgcagcgcgatctccgtcgccatcaccattagcaccaccatcctgggactccttggagttcccttcgcgtcccagatcggtgccttctacaacttcgtgctcaacaccgtgtggcctcagggaaataaccagtgggaggagttcatgaggcacgtggagaacctcatcaacgagcgcattgctgactacgcgcgcgacaaagccttggccgagctgaccggcctgggcaacaacctgaatctctatcgggaggctttcgaggactggcggcggaacccgacctcccaggaagccaagactcgggtgatcgaccgctttcgtattctcgacggcctgttcgagacttacatgccctccttcgcggtccgcaactttgaggttcagctcctgactgtgtacgcctcggctgcaaacatacacctgttcctgctgcgggacagctcgatctacggtttggactggggcctgtcacagaccaacgtgaacgagaactacaaccggcagatccgccacgccgccacctatgcaaaccactgcaccacttggtatcagacagggctccagcgcctccagggcactaacgcaacgtcatgggttgcatacaaccggtttcggcgggagatgacactcaccgtgttggacatctgctcgctgttctccaactacgactaccggtcgtacccgactgaggtgaagggcgagttgaccagggaaatctacacagaccctgtcggccggaactggcagaacgtcgcgccttcattcgcggagattgagaacctgaccattcgcgctccgcgtaccgtcacttggctcaactccactcggatcttcacagggacgctgaccggctggtccgggtccaaccgctactgggccgcccacatgcagaacttcagcgagacaaactctggcaacatcggattcgatggcccacagtatgggtccacggtcgggacgatacaccggaccgacgactacgacatggtgaaccgggacatctacaccataacgagccaggcagtcgccgccctctggcccaccggccagacagtcctgggcgtggcgagcacccgcttcacactgaggaatctgaacaacaactcgacggaggcactcgtgtacgagaacgccatctcgtcctccttcgttagcagcactctcactcatgagctgccgggcgagaacagcgaccgcccaacgagcagcgattacagccaccgtctttcctccatcacgggcttccgggctggagccaacgggaccgtgcccgtgttcggttggaccagcgcgacagttgaccgtaacaacatcatcgagcagaacaagatcacccagttccctggcgttaagtcacacactcttaacaactgtcaagtggtgcgtggcaccgggttcaccggcggcgactggcttcgcccaaacaacaatggcacctttcggctgaccattaccagcttctcgtcccagtcctaccgcatcaggcttcgatacgctaccagcgtcggcaacacctctcttgtcatctcgtcatccgacgcgggcatctccagtaccacaatccctctgacatccaccatcacgtcgctcccgcagaccgttccgtaccaggcgttccgcgtcgtcgatctcccgatcactttcactactccgaccactcagcgcaattacaccttcgatttccgcctccagaacccgagcaacgctaacgtattcatcgaccgcttcgagttcgtaccaatcggctag

SEQ ID NO: 53 - protein, 637 aa, Artificial
  The amino acid sequence of the CR-BREla.TIC7042_1.nno_Mc:1 protein, comprising amino acids 11 through 646 of TIC70.
MQIIEPSSDSFLYSHNNYPYATDPDTILKGRNYKEWLNMCTDTDDSRSPEAASTARSAISVAITISTTILGLLGVPFASQIGAFYNFVLNTVWPQGNNQWEEFMRHVENLINERIADYARDKALAELTGLGNNLNLYREAFEDWRRNPTSQEAKTRVIDRFRILDGLFETYMPSFAVRNFEVQLLTVYASAANIHLFLLRDSSIYGLDWGLSQTNVNENYNRQIRHAATYANHCTTWYQTGLQRLQGTNATSWVAYNRFRREMTLTVLDICSLFSNYDYRSYPTEVKGELTREIYTDPVGRNWQNVAPSFAEIENLTIRAPRTVTWLNSTRIFTGTLTGWSGSNRYWAAHMQNFSETNSGNIGFDGPQYGSTVGTIHRTDDYDMVNRDIYTITSQAVAALWPTGQTVLGVASTRFTLRNLNNNSTEALVYENAISSSFVSSTLTHELPGENSDRPTSSDYSHRLSSITGFRAGANGTVPVFGWTSATVDRNNIIEQNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIG

SEQ ID NO: 54 - DNA, 1974 bp, Artificial
  A synthetic coding sequence used for expression in plant cells, CR-BREla.TIC7042_2.nno_Mc:1 which encodes a protein having an N-terminal and C-terminal truncation relative to the TIC7042 protein.
atgcagatcatcgagccgtcgagcgactccttcctctattcccacaacaactacccgtacgccactgacccggacacgatcctcaagggccggaactacaaggagtggctcaacatgtgcaccgatacggacgactcgcgctcgcccgaggccgcgagcacggctcgcagcgcgatctccgtcgccatcaccattagcaccaccatcctgggactccttggagttcccttcgcgtcccagatcggtgccttctacaacttcgtgctcaacaccgtgtggcctcagggaaataaccagtgggaggagttcatgaggcacgtggagaacctcatcaacgagcgcattgctgactacgcgcgcgacaaagccttggccgagctgaccggcctgggcaacaacctgaatctctatcgggaggctttcgaggactggcggcggaacccgacctcccaggaagccaagactcgggtgatcgaccgctttcgtattctcgacggcctgttcgagacttacatgccctccttcgcggtccgcaactttgaggttcagctcctgactgtgtacgcctcggctgcaaacatacacctgttcctgctgcgggacagctcgatctacggtttggactggggcctgtcacagaccaacgtgaacgagaactacaaccggcagatccgccacgccgccacctatgcaaaccactgcaccacttggtatcagacagggctccagcgcctccagggcactaacgcaacgtcatgggttgcatacaaccggtttcggcgggagatgacactcaccgtgttggacatctgctcgctgttctccaactacgactaccggtcgtacccgactgaggtgaagggcgagttgaccagggaaatctacacagaccctgtcggccggaactggcagaacgtcgcgccttcattcgcggagattgagaacctgaccattcgcgctccgcgtaccgtcacttggctcaactccactcggatcttcacagggacgctgaccggctggtccgggtccaaccgctactgggccgcccacatgcagaacttcagcgagacaaactctggcaacatcggattcgatggcccacagtatgggtccacggtcgggacgatacaccggaccgacgactacgacatggtgaaccgggacatctacaccataacgagccaggcagtcgccgccctctggcccaccggccagacagtcctgggcgtggcgagcacccgcttcacactgaggaatctgaacaacaactcgacggaggcactcgtgtacgagaacgccatctcgtcctccttcgttagcagcactctcactcatgagctgccgggcgagaacagcgaccgcccaacgagcagcgattacagccaccgtctttcctccatcacgggcttccgggctggagccaacgggaccgtgcccgtgttcggttggaccagcgcgacagttgaccgtaacaacatcatcgagcagaacaagatcacccagttccctggcgttaagtcacacactcttaacaactgtcaagtggtgcgtggcaccgggttcaccggcggcgactggcttcgcccaaacaacaatggcacctttcggctgaccattaccagcttctcgtcccagtcctaccgcatcaggcttcgatacgctaccagcgtcggcaacacctctcttgtcatctcgtcatccgacgcgggcatctccagtaccacaatccctctgacatccaccatcacgtcgctcccgcagaccgttccgtaccaggcgttccgcgtcgtcgatctcccgatcactttcactactccgaccactcagcgcaattacaccttcgatttccgcctccagaacccgagcaacgctaacgtattcatcgaccgcttcgagttcgtaccaatcggcggctcactgtccgagtacgagacgaagcaccaactggagaaggctcgcaaggcagtgaactag

SEQ ID NO: 55 - protein, 657 aa, Artificial
  The amino acid sequence of the CR-BREla.TIC7042_2.nno_Mc:1 protein, comprising amino acids 11 through 665 of TIC7042.
MQIIEPSSDSFLYSHNNYPYATDPDTILKGRNYKEWLNMCTDTDDSRSPEAASTARSAISVAITISTTILGLLGVPFASQIGAFYNFVLNTVWPQGNNQWEEFMRHVENLINERIADYARDKALAELTGLGNNLNLYREAFEDWRRNPTSQEAKTRVIDRFRILDGLFETYMPSFAVRNFEVQLLTVYASAANIHLFLLRDSSIYGLDWGLSQTNVNENYNRQIRHAATYANHCTTWYQTGLQRLQGTNATSWVAYNRFRREMTLTVLDICSLFSNYDYRSYPTEVKGELTREIYTDPVGRNWQNVAPSFAEIENLTIRAPRTVTWLNSTRIFTGTLTGWSGSNRYWAAHMQNFSETNSGNIGFDGPQYGSTVGTIHRTDDYDMVNRDIYTITSQAVAALWPTGQTVLGVASTRFTLRNLNNNSTEALVYENAISSSFVSSTLTHELPGENSDRPTSSDYSHRLSSITGFRAGANGTVPVFGWTSATVDRNNIIEQNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETKHQLEKARKAVN

SEQ ID NO: 56 - DNA, 3813 bp, Artificial
  A synthetic coding sequence used for expression in plant cells, CR-BREla.TIC7381_1.nno_Mc:1 which encodes a TIC7381 protein wherein an additional alanine codon is inserted immediately following the initiating methionine codon.
atggctaaccagaaccagaacaagaacgagctacagataatcgagccgtcctcggattccttgctgtactcgcacaacaactacccgtacgccaccgatccgaacacggtgctagagggccgcaactacaaggagtggctgaataagtgcacagacaactacaccgatgcactgcaaggcccagaggcaacggctatcagcaagggtgccgtgtcggccgctatctctatcagcaccaaagtcttgagccttctgggagtgcccttcgcagctcagattgggcaattgtggacgtttattctgaacgctctttggccctcggacaacacccagtgggaggagttcatgcgccatgtcgaggagctcatcaaccagcgtatcgccgactacgcgcggagtaaggcgctcgccgagctcacgggcctgggcaacaacctcgatctgtacatcgaagctcttgaggactggaagcgcaacccgacctctcaacaagccaaggaccgggtgaaggaccgcttccgcatcgccgacggcctcttcgaagcgtacatgcctagcttccgcgtgagcggctatgaagtgccattgctcaccgtatatgcggcggcggccaacctgcacctcctcctcctccgcgactgctctatctacggcattcagtggggtttctcccagaccaatgtcaacgagaactataatcggcagatccgtcacaccgccgagtacgcgaaccactgcacgacatggtaccagacgggcctggagcgactgcgcggcacgaacgcctcaagctgggtgccgtacaaccgtttcaggagagagatgactctcaccgtgctcgacatctgcagtctgttctccaactatgactacaggagttacccggcagaggtgcgggctgagctgaccagggagatatacacggacccggtggtcagcacctctctgtgggtgaacaacgcgccgtccttcggcgaaatcgagaatctggcaatccgagcgccacgcaccgtgacatggctcaattcgacgcgtattagcactggcacactccaaggttggtctgggtccaacaggtactgggccgcccacatgcagaacttctcggagactaactccggcaacataggcttcgacggcccgctgtacgggtccactgtgggtacaatcattcgcgatgacaattacgagatggtcaaccgggacatttacaccatcacttcggaggcggttgcggctttgtggcccacgggccagattgtgctgggcgtggcttccgcaagattcacccttcgaaacctcaacaacaacctgacccaggcgctggtctacgagaacccgatatcaagcagtttcaaccggtcaactctcacacgcgagttgccgggcgagaacagcgacaggcccacctcttcggactactcccaccgtctcactagcatcactgcgttccgcgcaggcagtaacggtacgattcctgtgttcggctggaccagtatctccgtcaacagggacaacatactggagcggaacaagatcacccagttccctggcgttaagtcccataccctgaacaattgccaggtcgtccgcggtacaggctttaccggcggcgactggcttcggcctaacaacaacgggtcgttccgattgactatcacctcgttcagctcacagagttacagaatcaggctgcggtacgcgtccgcagcgaatacctccctgcgaatctcgtcttcggcggccgggatctcgtcaacaaccgtcccactcgcctccacgatcactagcctcccgcagacagccgtcccatacgaggcgttccgggtgatcgacctgccaatcacgttcaccaccgcgacgcagtctaactacactttcgacttcgtcctccagaatccttccaacgccaacgtgttcatcgaccgcttcgagtttgtcccgattggaggttcgctctcagagtacgagacgaagcaccagctggagaaggcacgtaaggcggtgaacgatctgtttactaacgagtcaaagaacgttctgaagaagtatacgaccgactacgacattgaccaggccgccaacctggtggagtgtgtgtcggacgagtgcgctaacgcaaagatgatcctcctagacgaggtgaagtatgcgaagcaactgtcagaggcgcggaacctgctcctgaacggtaatttcgaataccaggatagagacggcgagaacccgtggaagacctcacctaacgttactatccaggagaacaacccaatcttcaagggccgctacctttccatgtccggcgccaactacatcgaggcgaccaacgacactttcccgacctacgcttatcaaaagatcgacgaggccaagctgaagccttacactcgctacaaggtgcgtggtttcgtgggcaattccaaggatctggagctgctgatcaaaaggtacgacgaggaagtggacgctattctcaacgtcccgaacgacattccgcacgcgccaacgccattctgcggcggattcgaccgttgcaagccgcactcttacatcccgatgaatcccgaatgccaccacgacgtgatcaataacatcgagatcagctcgccatgtcagcataacaagatgctcgacaacgcggacatctccagccgtcactccgaactcggcaagaagcacgggatctgtcacgagtcgcaccacttcgagttccacatcgacactggcaagatccacctcaacgagaacctgggcatctgggtgatcttcaagatctgctctaccgatggctacgccaccctggacaatcttgaggtgatcgaagagggaccgcttggtgcggagtccctcgagcgcgtcaagcgacgcgagaagaagtggaagcaccacatggagcacaaatgttccgagacgaaacttgcgtaccatgccgccaagcaggcccttgttgggctgttcacgaacaccaagtacgataggctcaagttcgagaccaccatctcgaacattctgtttgccgactaccttgtgcagtcaattccatacgtttacaacaaatggctgccagatgtcccgggtatgaactatgacatctacaccgagcttaagaacctcttcactggcgccttcaacctgtacgaccagcgtaacatcataaagaacggcgacttcaaccgtggcttgatgcactggcacgccacgccgcacgcccgtgtcgagcagatcgacaaccgctcggttctcgtgctccctaactacgccgctaacgtctcgcaggaggtctgcctcgagcataaccgcggctacgtgctgcgggtaactgccaagaaggagggccctggcattggatacgttaccttctcggactgcgcgaacaacatcgagaaactgaccttcacgtcatgtgactatggaaccaacgaggtcacctacgagcagtccaattacccgaccgatggcgtcccttacgagcaacacgggtgccacactgacggcgtgccgtacgagcagcatgggtgccacactgacggcgtcccttacgagcagcacggctgccacacggacggcgtaccgtacaagcagcatggctgccgcaccgacggcgttccttacaagcagcacggctgccgcaccgacggagtcccgtacaagcagcatgggtgtcgcaccgaccggtcccgcgacgagcagctggattacgtaacgaagacgatcgacgtcttcccggacacggacaaggtcaggatcgacattggcgaaacggagggaaccttcaaagtcgagtcagtggagcttatcttcatggaggagtga

SEQ ID NO: 57 - protein, 1270 aa, Artificial
  The amino acid sequence of CR-BREla.TIC7381_1.nno_Mc:1 wherein an additional alanine amino acid is inserted immediately following the initiating methionine relative to the TIC7381 protein sequence.
MANQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWVNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLASTITSLPQTAVPYEAFRVIDLPITFTTATQSNYTFDFVLQNPSNANVFIDRFEFVPIGGSLSEYETKHQLEKARKAVNDLFTNESKNVLKKYTTDYDIDQAANLVECVSDECANAKMILLDEVKYAKQLSEARNLLLNGNFEYQDRDGENPWKTSPNVTIQENNPIFKGRYLSMSGANYIEATNDTFPTYAYQKIDEAKLKPYTRYKVRGFVGNSKDLELLIKRYDEEVDAILNVPNDIPHAPTPFCGGFDRCKPHSYIPMNPECHHDVINNIEISSPCQHNKMLDNADISSRHSELGKKHGICHESHHFEFHIDTGKIHLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVTYEQSNYPTDGVPYEQHGCHTDGVPYEQHGCHTDGVPYEQHGCHTDGVPYKQHGCRTDGVPYKQHGCRTDGVPYKQHGCRTDRSRDEQLDYVTKTIDVFPDTDKVRIDIGETEGTFKVESVELIFMEE

SEQ ID NO: 58 - DNA, 3744 bp, Artificial
  A synthetic coding sequence used for expression in plant cells, CR-BREla.TIC7382_1.nno_Mc:1 which encodes a TIC7382 protein wherein an additional alanine codon is inserted immediately following the initiating methionine codon.
atggctaaccagaaccagaaccagaacaagaacgagatgcagatcatcgagccctcctccgactcattcctctactcgcacaacaactacccctacgcgacggaccccaacactgttctcgaagggcggaactacaaggagtggctaaacaagtgcactaacaattacaccgacgcgctccagtctccggaagccacagccatttcgaagggggcggtctcggcggcgatcagcatcagcaccaaggtgctcggcctcctcggcgtgccgttcgcggctcagataggacagctctggacattcattctgaacgccctgtggccgtccgacaacacccagtgggaggagttcatgcggcacgtcgaggagctcatcaaccagcggatcgcagactatgcccgtaacaaggccctggccgagctgacgggactcggcaacaacctcgacctctacatcgaggccctggatgactggaagaggaaccccaccagccaggaggccaagactcgcgtcatcgaccgcttccgcatcgtcgacgggctgttcgaggcctacattccgagcttcgccgtgagcggctatcaagttcagctgctcactgtctacgccgctgcagcaaacctccacctcctgctgctgcgcgactccacgatctacggaatcgactggggcctttcccagactaacgtcaacgataactacaaccggcagattcgtctcaccgcgacgtacgctaaccactgtacaacgtggtaccagacaggactggagcggctccgcgggagcaacgcgtcttcctgggtgacctacaaccgtttccggagagagatgactctcacagtcttggacatctgttccttgttcagcaactacgactatcgcagctacccggccgaggttcgcggcgagattacgagggaaatctacacagaccctgtcggcgtcggttgggttgacagcgcgccttctttcggcgagatcgagaacctggcgatccgggcgccacggactgtgacctggctgaactccacccggatctccaccggcaccttaagcggctggtcgggctctaaccggtactgggcggcccacatgcagaatttctccgagacaaactcgggtaacatcggcttcgatgggccgctgtacgggagcacagtgggcaccatccaccgcactgatgactacgacatgggcaaccgggacatctacacgataacgtcgcaggccgttctcggtctgtggcccacgggccagcgggtcctgggagtcgcatctgcgcgtttcaccctcaggaacctattcaataacctgacccaggtgctggtatacgagaatcctattagctccaacttcggctcttcaacgctaacccacgagttatccggcgagaacagcgataggcccaccagcagcgattactcacatcgactcacaagcatcacgggattccgcgcaggagcaaatggtaccgttcccgtctttgggtggaccagcgccacagtcgaccggaacaacatcatcgagcgcaacaagatcacgcagttcccaggcgtcaaatcgcacacgctaaacaactgccaggtggtgaggggaaccggtttcaccggaggtgactggttaagaccaaataacaacggcactttccgcctcactattacgagcttctcctcccaaagttaccgcatccgccttcgctacgccacgtcagtggggaacacctcgctggtgatatcctcctcagacgccgggatcagcagcaccacgataccactaacatccacaataacctcattgccgcagacggtcccgtatcaggccttcagagtggtggaccttcctattacgttcacgacgcccacgacccagcgcaactacacattcgatttccggttgcagaacccgagtaacgccaatgtcttcatcgatcgtttcgagttcgtcccgataggcggctccctttcggagtacgaaacgaagcaccagttggagaaggctcgcaaggcggtcaacgatctcttcaccaacgagtcgaagaacgtcctgaagaaggagacgaccgattacgacatcgaccaagctgctaacttggtggagtgcattagtgacgagtgcgcgaacgccaagatgatccttctcgacgaagtgaagtacgccaagcagctctccgaggcccgcaacctgcttctgaacgggaacttcgacaaccttgatcgcaatggcgagaacccgtggaagaccagccctaacgtgactattcaggagaacaatcctatcttcaaagggaggtacctaagtatgagtggagccaacaacatcgaggcgactaacgagatcttcccaacatatgtgtaccagaagatcgacgaagccaagctcaagccttacacgcggtacaaggtccgcgggtttgtgggcagttccaaggacttagagcttctggtgactcgatacgacgaggaggttgatgccatactgaacgttctgaacgatatcccgcacgcaccaccaccgttctgcggcggcttcgacaggtgcaaaccgcactcctacccgccgatgaacccggagtgccaccacgacgtgataaacaacatcgagatctccagtccgtgccagcacaacaagatgctggacaacgccgatatcttcagccgccacagtgagctgggcaagaagcacgggatctgccacgaatcccaccacttcgagttccacatcgacacagggaagatcgacctcaacgagaacctcggcatatgggtcatcttcaagatctgctcgaccgatggctacgcgacccttgacaatcttgaggtgatcgaggagggaccgctcggcgctgagagtctcgagcgggttaagaggagggaaaagaaatggaagcaccacatggagcataagtgctccgagaccaaacttgcctaccacgccgccaagcaggcactcgtgggcctcttcaccaacaccaagtatgaccggcttaagttcgagacaacgatcagcaacatcctattcgcggactacttagtccagagcatcccttacgtttacaacaaatggctgcctgacgtgcccggtatgaactacgacatctacaccgagctcaagaacctcttcaccggcgcattcaacctgtacgaccagcggaacattatcaagaacggcgacttcaaccgaggactgatgcactggcacgcgactccgcacgcccgggttgaacagatcgacaacaggtccgtgctcgtgctcccgaactacgcggccaacgtgtctcaggaggtttgcctcgagcacaaccgcggctacgtcttgcgcgtcacagccaagaaggagggcccggggatcggttatgtcacgttcagcgactgcgccaacaacatcgagaagctcacgttcacgtcgtgcgattatggtaccaacgaggtgccgtacgagcagtcaggctacggcacgaacgaggttccgtacgagcagagcggctacggaacgaacgaggtgccgtacgagcagtccgggtaccggacggacggcgtgccctacaagcagcatggctgccggaccgacggcgtgccctacgagcagagcggctgccgcacggaccggagcagggatgagcagctggactacgtgaccaagacgatcgacgtcttcccggacacggacaaggtccggattgacatcggcgagactgagggcaccttcaaggtcgaaagcgtggagctattctgcatggaggagtag

SEQ ID NO: 59 - protein, 1247 aa, Artificial
  The amino acid sequence of CR-BREla.TIC7382_1.nno_Mc:1 wherein an additional alanine amino acid is inserted immediately following the initiating methionine relative to the TIC7381 protein sequence.
MANQNQNQNKNEMQIIEPSSDSFLYSHNNYPYATDPNTVLEGRNYKEWLNKCTNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNIIERNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETKHQLEKARKAVNDLFTNESKNVLKKETTDYDIDQAANLVECISDECANAKMILLDEVKYAKQLSEARNLLLNGNFDNLDRNGENPWKTSPNVTIQENNPIFKGRYLSMSGANNIEATNEIFPTYVYQKIDEAKLKPYTRYKVRGFVGSSKDLELLVTRYDEEVDAILNVLNDIPHAPPPFCGGFDRCKPHSYPPMNPECHHDVINNIEISSPCQHNKMLDNADIFSRHSELGKKHGICHESHHFEFHIDTGKIDLNENLGIWVIFKICSTDGYATLDNLEVIEEGPLGAESLERVKRREKKWKHHMEHKCSETKLAYHAAKQALVGLFTNTKYDRLKFETTISNILFADYLVQSIPYVYNKWLPDVPGMNYDIYTELKNLFTGAFNLYDQRNIIKNGDFNRGLMHWHATPHARVEQIDNRSVLVLPNYAANVSQEVCLEHNRGYVLRVTAKKEGPGIGYVTFSDCANNIEKLTFTSCDYGTNEVPYEQSGYGTNEVPYEQSGYGTNEVPYEQSGYRTDGVPYKQHGCRTDGVPYEQSGCRTDRSRDEQLDYVTKTIDVFPDTDKVRIDIGETEGTFKVESVELFCMEE

SEQ ID NO: 60 - DNA, 1983 bp, Artificial
  A synthetic coding sequence used for expression in plant cells, CR-BREla.TIC7382_2.nno_Mc:1 which encodes a protein comprising a C-terminal truncation relative to the TIC7382 protein and wherein an alanine codon is inserted after the initiating methionine.
atggctaaccagaaccagaaccagaacaagaacgagatgcagatcatcgagccctcctccgactcattcctctactcgcacaacaactacccctacgcgacggaccccaacactgttctcgaagggcggaactacaaggagtggctaaacaagtgcactaacaattacaccgacgcgctccagtctccggaagccacagccatttcgaagggggcggtctcggcggcgatcagcatcagcaccaaggtgctcggcctcctcggcgtgccgttcgcggctcagataggacagctctggacattcattctgaacgccctgtggccgtccgacaacacccagtgggaggagttcatgcggcacgtcgaggagctcatcaaccagcggatcgcagactatgcccgtaacaaggccctggccgagctgacgggactcggcaacaacctcgacctctacatcgaggccctggatgactggaagaggaaccccaccagccaggaggccaagactcgcgtcatcgaccgcttccgcatcgtcgacgggctgttcgaggcctacattccgagcttcgccgtgagcggctatcaagttcagctgctcactgtctacgccgctgcagcaaacctccacctcctgctgctgcgcgactccacgatctacggaatcgactggggcctttcccagactaacgtcaacgataactacaaccggcagattcgtctcaccgcgacgtacgctaaccactgtacaacgtggtaccagacaggactggagcggctccgcgggagcaacgcgtcttcctgggtgacctacaaccgtttccggagagagatgactctcacagtcttggacatctgttccttgttcagcaactacgactatcgcagctacccggccgaggttcgcggcgagattacgagggaaatctacacagaccctgtcggcgtcggttgggttgacagcgcgccttctttcggcgagatcgagaacctggcgatccgggcgccacggactgtgacctggctgaactccacccggatctccaccggcaccttaagcggctggtcgggctctaaccggtactgggcggcccacatgcagaatttctccgagacaaactcgggtaacatcggcttcgatgggccgctgtacgggagcacagtgggcaccatccaccgcactgatgactacgacatgggcaaccgggacatctacacgataacgtcgcaggccgttctcggtctgtggcccacgggccagcgggtcctgggagtcgcatctgcgcgtttcaccctcaggaacctattcaataacctgacccaggtgctggtatacgagaatcctattagctccaacttcggctcttcaacgctaacccacgagttatccggcgagaacagcgataggcccaccagcagcgattactcacatcgactcacaagcatcacgggattccgcgcaggagcaaatggtaccgttcccgtctttgggtggaccagcgccacagtcgaccggaacaacatcatcgagcgcaacaagatcacgcagttcccaggcgtcaaatcgcacacgctaaacaactgccaggtggtgaggggaaccggtttcaccggaggtgactggttaagaccaaataacaacggcactttccgcctcactattacgagcttctcctcccaaagttaccgcatccgccttcgctacgccacgtcagtggggaacacctcgctggtgatatcctcctcagacgccgggatcagcagcaccacgataccactaacatccacaataacctcattgccgcagacggtcccgtatcaggccttcagagtggtggaccttcctattacgttcacgacgcccacgacccagcgcaactacacattcgatttccggttgcagaacccgagtaacgccaatgtcttcatcgatcgtttcgagttcgtcccgataggcggctccctttcggagtacgaaacgaagtga

SEQ ID NO: 61 - protein, 660 aa, Artificial
  The amino acid sequence of CR-BREla.TIC7382_2.nno_Mc:1 comprising a C-terminal deletion, an additional alanine amino acid, and comprises amino acids 1 through 659 of TIC7382.
MANQNQNQNKNEMQIIEPSSDSFLYSHNNYPYATDPNTVLEGRNYKEWLNKCTNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNIIERNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETK

SEQ ID NO: 62 - DNA, 3774 bp, Artificial
  A synthetic coding sequence used for expression in plant cells, CR-BREla.TIC7383_1.nno_Mc:1 which encodes a TIC7383 protein wherein an additional alanine codon is inserted immediately following the initiating methionine codon.
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagcacgagcttgaaaaggcgaaaaaagcagttaacgacctcttcacgaacgagtccaaaaacatgttaaagaaagacacgaccgactacgacatcgaccaggctgcggacctggtggagtgcgtaagcgacgagtgcgcccacgctaagatgatactgctggacgaagtgaagtacgcgaagcagctgagcgaggctcggaacctgctccagaacgggaacttcaaggtcttagacgttgacaacaacaacccgtggacgacctcaccgaacgtaacgatccaggagaacaacccgatcttcaaaggtcactacctctccatgtccggtgcgaacgcaatcgaggccaccaacgaggtgttcccaacgtacgtgtaccaaaagattgaggagagtaaactcaagccctacacaaggtacaaggtgcgggggttcatcggccagagcaaggacgtcgagctgctcgtcacgcgttacgacgaggaggtggacgctattctgaacgtgcctaacgacctaaagtacgcagtgccgacgcacctgtcgggagagttcaaccgctgcaagcctcacacttacccggccacagacccccgatgccacgacgacgtgatcgacaagatcgacatctcctcgccgtgtcagaacaacattatgctgtcggacgcggacatctctagtcttcatagcggacttggcaagaagcacgggatctgccacgagagccatcacttcgagttccacatcgacacgggcaaaatcgacctcgtggagaaccttggcatctgggtgatcttcaagatctgctctaccgacggatacgcgacgctcgacaatctggaagtaatagaggaaggcccgttgggcgcagagtccctagagcgggtgaagcgtagggagaagaagtggaagcataacatggagcacaagtgctcggaaacgaaacacgcataccacgcggcgaagcaggctgtcgaagcactcttcacgaacttcaaggacgagaggctcaagttcgagacgacgattagtaacatcctgtcagctgagtacctagtccagtccatcccatacgtctacaacaagtggctgtcggacgtacctgggatgaactacgacatctacaccgagctcaagaaccgcatctggcaagcgttcaacttgtacgaccagaggaacatcatcaagaacggccacttcaatcatggtttaatgcattggcacgcgacaccgcacgcgaacgtgcagcaaatagacggtatttccgtgctggtcctcccaaactggggggccaacgtcagccaggaggtgtgcctcaagcacaaccggggctacgtgctgcgagtcacggccaaggaggagggtcacggcaagggctacgtgacgatttcggactgcgctaaccaggtcgagaagctgtcgttcactagccgcgactactctaccgacggcgtcccatacgaacagtccaactacccgaccgacggagtgtcttacgggcagcacgggtgcaacatcgaccgagtgccctacgagcaatctggctaccccaccgacggggttccttacgaacagtcgggctaccgtacggacggggtcccgtacaagcagcatggatgccactcggacggaagccgtgaggagcagcacgggtacgttacgaagactatcgacgtcttccccgacacggacaaggtccggatcgacatcggcgagaccgaggggacgttcaaggttgagagcgtggagctcatctgcatggaggagtag

SEQ ID NO: 63 - protein, 1257 aa, Artificial
  The amino acid sequence of CR-BREla.TIC7383_1.nno_Mc:1 wherein an additional alanine amino acid is inserted immediately following the initiating methionine relative to the TIC7383 protein sequence.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERVKRREKKWKHNMEHKCSETKHAYHAAKQAVEALFTNFKDERLKFETTISNILSAEYLVQSIPYVYNKWLSDVPGMNYDIYTELKNRIWQAFNLYDQRNIIKNGHFNHGLMHWHATPHANVQQIDGISVLVLPNWGANVSQEVCLKHNRGYVLRVTAKEEGHGKGYVTISDCANQVEKLSFTSRDYSTDGVPYEQSNYPTDGVSYGQHGCNIDRVPYEQSGYPTDGVPYEQSGYRTDGVPYKQHGCHSDGSREEQHGYVTKTIDVFPDTDKVRIDIGETEGTFKVESVELICMEE

SEQ ID NO: 64 - DNA, 1854 bp, Artificial
  A synthetic coding sequence used for expression in plant cells, CR-BREla.TIC7383_7.nno_Mc:1 which encodes a protein comprising an N-terminal and C-terminal truncation relative to the TIC7383 protein with an alanine codon after initiating methionine.
atggctaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 65 - protein, 617 aa, Artificial
  The amino acid sequence of CR-BREla.TIC7383_7.nno_Mc:1 comprising an N-terminal and C-terminal deletion, an additional alanine amino acid, and comprises amino acids 54 through 668 of TIC7383.
MATDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 66 - DNA, 1989 bp, Artificial
  A synthetic coding sequence used for expression in plant cells, CR-BREla.TIC7383_8.nno_Mc:1 which encodes a protein comprising a C-terminal truncation relative to the TIC7383 protein with an additional alanine codon is insert after initiating methionine.
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 67 - protein, 662 aa, Artificial
  The amino acid sequence of CR-BREla.TIC7383_8.nno_Mc:1 comprising a C-terminal deletion, an additional alanine amino acid, and comprises amino acids 1 through 661 of TIC7383.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 68 - DNA, 2010 bp, Artificial
  A synthetic coding sequence used for expression in plant cells, CR-BREla.TIC7383_9.nno_Mc:1 which encodes a protein comprising a C-terminal truncation relative to the TIC7383 protein with an additional alanine codon insert after initiating methionine.
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 69 - protein, 669 aa, Artificial
  The amino acid sequence of CR-BREla.TIC7383_9.nno_Mc:1 comprising a C-terminal deletion, an additional alanine amino acid, and comprises amino acids 1 though 668 of TIC7383.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 70 - DNA, 1746 bp, Brevibacillus laterosporus
  misc_feature (1)..(1746): A coding sequence encoding the Tryptic core of the TIC7040HT protein as determined by mass spectrometry.
aattataaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagt

SEQ ID NO: 71 - protein, 582 aa, Brevibacillus laterosporus
  MISC_FEATURE (1)..(582): The amino acid sequence of the Tryptic core of the TIC7040HT protein as determined by mass spectrometry, and comprises amino acids 43 through 624 of TIC7040HT.
NYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQS

SEQ ID NO: 72 - DNA, 1791 bp, Brevibacillus laterosporus
  misc_feature (1)..(1791): A coding sequence encoding the Chymotryptic core of the TIC7040HT protein as determined by mass spectrometry.
aaagagtggctaaataagtgcacagataattatacagacgctttacagggtcccgaagctactgctatatcaaaaggagctgtctctgctgcgatttctatcagcaccaaagttcttagtttattaggtgttccgtttgcagctcaaatcggacaactttggaccttcatattgaatgcgttatggccttcagacaatactcaatgggaagagttcatgagacatgtagaagaactcataaaccaacgaatagccgattatgcaagaagtaaggcacttgcagaattaacgggtttaggtaataacttagatttatatatagaagctcttgaagattggaaacgaaatcctactagtcaacaagcgaaagaccgtgtaaaagatagattccgtatagcagatggtttatttgaagcgtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgcttccagttgggtcccttataatcgtttccgaagagaaatgacgttaactgtattggatatttgttccttattttcaaattatgattatcgtagttatccagcagaggtaagggcagagcttacaagagaaatttatacggacccagttgtaagcactagcttgtggatgaataatgcaccatcattcggagaaatagaaaatctagcaattagggcgccaagaaccgttacttggttaaattctacaagaatttctacagggaccttgcagggctggagtggttctaacagatattgggcagctcacatgcaaaacttttcagaaaccaattcaggaaatataggatttgacggtcctctctatgggtcgacggtaggtactattattcgtgatgataattacgaaatggtgaaccgagatatttacaccattacttcagaggctgttgccgccctttggccaactggtcaaattgtgttgggagtcgcttcggctagatttactttaagaaatcttaacaataatcttacacaggcgctggtgtatgagaacccaataagttcaagttttaataggtcaactttaactcgtgaattacctggggaaaactcagataggccaacttcaagcgactatagtcatagactaacgtctattacagcttttcgagctggaagtaatgggacgattccggtttttggatggacatctataagtgttaatcgtgacaatatacttgagcgaaacaaaataacacaattcccaggcgttaagtcacacactctcaacaattgtcaagtagttagaggtactggatttacaggaggagactggttgagaccaaataataatggttcatttagattaactattacttcattctcgagccaatcttaccgaatccgcttacgttatgcttccgcagcaaatacttctttgcgtatatcttcttctgcagccggtatttcttccacaaccgttccgcttacctcaacaataacatcactgccacaaactgctgtaccatatgaagcttttagagttatagatttacctattacttttacaacagctacccaaagtaattatacttttgattttgttctccaaaatccatcaaacgcaaatgtattc

SEQ ID NO: 73 - protein, 597 aa, Brevibacillus laterosporus
  MISC_FEATURE (1)..(597): The amino acid sequence of the Chymotryptic core of the TIC7040HT protein as determined by mass spectrometry, and comprises amino acids 45 through 641 of TIC7040HT.
KEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVF

SEQ ID NO: 74 - DNA, 1842 bp, Brevibacillus laterosporus
  misc_feature (1)..(1842): A coding sequence encoding the Tryptic core of the TIC7383 protein as determined by mass spectrometry.
gataattatacagacgctttacagggtcccgaagctactgctatatcaaaaggagctgtctctgctgcgatttctatcagcaccaaagttcttggtttattaggtgttccatttgcagctcaaatcgggcaactttggaccttcatattgaatgcgttatggccttcagacaatactcaatgggaagagttcatgagacatgtagaagaactcataaaccaacgaatagccgattatgcaagaaataaggcacttgcagaattaacggggttaggtaataacttagatttatatatagaggctcttgaagattggaaacgaaatcctactagtcaacaagcgaaagaccgtgtaatagatagattccgtatagcagatggtttatttgaagggtatatgccttcatttagagtatcaggttatgaagtaccattattaacagtgtatgcagccgctgcaaatctccatttacttttattaagagattgctctatttacggaatccaatggggatttagtcaaacgaatgttaacgagaattacaatcgccaaataagacacaccgcagagtatgcaaatcattgtacaacttggtaccaaactggtttagaaagattgcgaggtaccaatgctttcagttggatcaattataatcgattccgtagagaaatgacgttaaccgtattggatgtttgttcattattttcaaattatgattatcgtacgtatccaacagaggtaagagcagagcttacgagagaaatttatacggacccaataggttttcaaaatagtcctcttcctggcgttgttcctaattggtacgattacgcacgatcgttcgcagagatagaaaatatagccattcgagcgccacgaactgttacttggttaaattctacaactatttatacaggtagattaaatggctataacaatagtaattattattgggcaggtttcaggcaaaatttttcagaaaccaattcaggcagttcatttaacggtcctgacttaggggatttaacacctaattatcgtatagaaacattggatatggtgaatcgggatatttactccatttattcaagagttgtttcacaatcttggccaattggcaacgttaaattgtttggagtctcttcatctactctttcattcagagatcttaacaataattcttcagggacgctggtatatgaaaacccgacaaattttagtagccaatatctaactaccgaattccctggggaaaactcagaaagaccaacttttaccgattatagtcacagactaacttgtctcacacgtattggggctggaaattatggattggttctatgcgccggctggacatctagtagtgttgagcgtgacaacagactccagccggacaaaataacacaatacccggctgttaaaggattcaacctcgatggttttacagtagtaaaaggtactgggtttacagggggaaattggttgagatctagtcgtgttacaggtagctttagactaaatgtttattcaccgtctgtccaaacttatcgcatgcgtatacgttatgcttctccactgggaaattctactctaggtatatcttctactgatgctggtattagtttcacaagttttccacttccctcaacaataggatcaatgccatcaactgtaccatacgaagcttttagagttctagatatacctatcactgttacagtagctagtcaaagaaattataattttattttcgatattctaaatccatcagtcggagcagtatacattgacagaattgaattcgttccagttgggtcttctgtatttgaatatgaaaccaag

SEQ ID NO: 75 - protein, 614 aa, Brevibacillus laterosporus
  MISC_FEATURE (1)..(614): The amino acid sequence of the Tryptic core of the TIC7383 protein as determined by mass spectrometry, and comprises amino acids 55 through 668 of TIC7383.
DNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 76 - DNA, 1836 bp, Artificial
  A synthetic coding sequence used for expression in a plant cell, encoding a CR-BREla.TIC7040_14.nno_Mc:1 protein having an N-terminal and C-terminal truncation relative to the TIC7040HT protein, with an additional alanine codon.
atggctaccgacaactacaccgacgcgctccagggccctgaggccaccgccatcagcaagggcgcggtgtcagccgcgatctccatcagcacaaaggtgctctcgttactgggcgtgcccttcgcggcgcagatcggccagctctggacctttatcctgaacgccctatggcccagcgacaacacccagtgggaggagtttatgcgccacgtggaggaactcattaaccagcgaattgctgactacgccaggagcaaggccctggccgagctgacgggtcttggcaacaacctcgacctctacatcgaggcccttgaagactggaagcggaacccgaccagccaacaggccaaagaccgtgtgaaggaccggttccggatcgccgacgggctgttcgaggcgtacatgccctctttccgcgtcagcggctacgaggtgccactgttgaccgtttacgcggcagccgctaacctccacttgctgctcctgcgggattgctccatctacggtatccagtggggcttcagccagacaaacgtcaacgagaactacaaccgacagatccggcacacggccgagtacgcaaaccactgcacgacatggtatcagacagggcttgaacgccttcgtggcaccaacgcctcgtcatgggtgccgtacaaccggttccgccgagagatgaccctcaccgttcttgacatctgctcactgttcagcaactacgactaccggtcgtaccctgcggaggttcgggccgaactgacgcgggagatctacactgacccggtggtcagcacctcgttgtggatgaacaacgcgcccagcttcggtgagatcgagaacctcgccataagagcaccacgcaccgtcacttggctcaacagcacccggatctccacgggcaccttacagggctggagcggctccaaccgatactgggcagcgcacatgcagaacttctccgagactaactccggcaacatcggcttcgacggcccgctctacggcagcaccgtcgggaccatcatccgggacgacaactatgagatggtcaacagggacatctacacgattacctcggaggccgtggctgccctgtggccaaccggtcaaatagtgttgggagtcgcctccgcccgctttacgctgcgtaacctgaacaacaaccttacccaggcgctcgtgtacgagaacccgatctccagctccttcaataggtccaccctcacgagggagctgccgggtgagaacagcgacaggccgacgtcctcggactacagtcaccggctcacctcgatcacagcgttccgagccgggagcaacggaacgatcccagtcttcggatggaccagcatcagcgtcaaccgcgacaacatcctggaacgcaacaagatcactcagttccctggagttaagtctcacacgctcaacaactgccaagtggtgcgtggcacagggtttaccggaggcgactggcttcgcccgaacaacaatgggtcattccggctgaccattaccagcttctcatcgcaatcataccgcatccggctacggtacgcctcggcggcgaacactagccttcgcatctcctcttcagccgccgggatcagctcgacaaccgtcccgctgaccagcacgatcacgagcctgccacaaactgctgtgccttacgaggctttcagagtgatcgacctgcccattaccttcaccacggcaacccaatcgaactacactttcgacttcgtgttacagaatccgagcaacgccaacgtcttcatcgaccggttcgagttcgtgcccatcggcgggagcctctccgagtacgagaccaagtga

SEQ ID NO: 77 - protein, 611 aa, Artificial
  The amino acid sequence of the CR-BREla.TIC7040_14.nno_Mc:1 protein, wherein an additional alanine amino acid is inserted immediately following the initiating methionine, and comprises amino acids 52 through 660 of TIC7040HT.
MATDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWMNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLTSTITSLPQTAVPYEAFRVIDLPITFTTATQSNYTFDFVLQNPSNANVFIDRFEFVPIGGSLSEYETK

SEQ ID NO: 78 - DNA, 1980 bp, Artificial
  A synthetic coding sequence used for expression in a plant cell, encoding a CR-BREla.TIC7381_2.nno_Mc:1 protein with a C-terminal truncation, and an additional alanine codon after the intiating methionine codon.
atggctaaccagaaccagaacaagaacgagctacagataatcgagccgtcctcggattccttgctgtactcgcacaacaactacccgtacgccaccgatccgaacacggtgctagagggccgcaactacaaggagtggctgaataagtgcacagacaactacaccgatgcactgcaaggcccagaggcaacggctatcagcaagggtgccgtgtcggccgctatctctatcagcaccaaagtcttgagccttctgggagtgcccttcgcagctcagattgggcaattgtggacgtttattctgaacgctctttggccctcggacaacacccagtgggaggagttcatgcgccatgtcgaggagctcatcaaccagcgtatcgccgactacgcgcggagtaaggcgctcgccgagctcacgggcctgggcaacaacctcgatctgtacatcgaagctcttgaggactggaagcgcaacccgacctctcaacaagccaaggaccgggtgaaggaccgcttccgcatcgccgacggcctcttcgaagcgtacatgcctagcttccgcgtgagcggctatgaagtgccattgctcaccgtatatgcggcggcggccaacctgcacctcctcctcctccgcgactgctctatctacggcattcagtggggtttctcccagaccaatgtcaacgagaactataatcggcagatccgtcacaccgccgagtacgcgaaccactgcacgacatggtaccagacgggcctggagcgactgcgcggcacgaacgcctcaagctgggtgccgtacaaccgtttcaggagagagatgactctcaccgtgctcgacatctgcagtctgttctccaactatgactacaggagttacccggcagaggtgcgggctgagctgaccagggagatatacacggacccggtggtcagcacctctctgtgggtgaacaacgcgccgtccttcggcgaaatcgagaatctggcaatccgagcgccacgcaccgtgacatggctcaattcgacgcgtattagcactggcacactccaaggttggtctgggtccaacaggtactgggccgcccacatgcagaacttctcggagactaactccggcaacataggcttcgacggcccgctgtacgggtccactgtgggtacaatcattcgcgatgacaattacgagatggtcaaccgggacatttacaccatcacttcggaggcggttgcggctttgtggcccacgggccagattgtgctgggcgtggcttccgcaagattcacccttcgaaacctcaacaacaacctgacccaggcgctggtctacgagaacccgatatcaagcagtttcaaccggtcaactctcacacgcgagttgccgggcgagaacagcgacaggcccacctcttcggactactcccaccgtctcactagcatcactgcgttccgcgcaggcagtaacggtacgattcctgtgttcggctggaccagtatctccgtcaacagggacaacatactggagcggaacaagatcacccagttccctggcgttaagtcccataccctgaacaattgccaggtcgtccgcggtacaggctttaccggcggcgactggcttcggcctaacaacaacgggtcgttccgattgactatcacctcgttcagctcacagagttacagaatcaggctgcggtacgcgtccgcagcgaatacctccctgcgaatctcgtcttcggcggccgggatctcgtcaacaaccgtcccactcgcctccacgatcactagcctcccgcagacagccgtcccatacgaggcgttccgggtgatcgacctgccaatcacgttcaccaccgcgacgcagtctaactacactttcgacttcgtcctccagaatccttccaacgccaacgtgttcatcgaccgcttcgagtttgtcccgattggaggttcgctctcagagtacgagacgaagtga

SEQ ID NO: 79 - protein, 659 aa, Artificial
  The amino acid sequence of the CR-BREla.TIC7381_2.nno_Mc:1 protein with a C-terminal truncation, an additional alanine residue, and comprises amino acids 1 through 658 of TIC7381.
MANQNQNKNELQIIEPSSDSLLYSHNNYPYATDPNTVLEGRNYKEWLNKCTDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWVNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLASTITSLPQTAVPYEAFRVIDLPITFTTATQSNYTFDFVLQNPSNANVFIDRFEFVPIGGSLSEYETK

SEQ ID NO: 80 - DNA, 1836 bp, Artificial
  A synthetic coding sequence used for expression in plant cells encoding a CR-BREla.TIC7381_3.nno_Mc:1 with an N-terminal and C-terminal truncation and additional alanine codon after the initiating methionine relative to TIC7381.
atggctacagacaactacaccgatgcactgcaaggcccagaggcaacggctatcagcaagggtgccgtgtcggccgctatctctatcagcaccaaagtcttgagccttctgggagtgcccttcgcagctcagattgggcaattgtggacgtttattctgaacgctctttggccctcggacaacacccagtgggaggagttcatgcgccatgtcgaggagctcatcaaccagcgtatcgccgactacgcgcggagtaaggcgctcgccgagctcacgggcctgggcaacaacctcgatctgtacatcgaagctcttgaggactggaagcgcaacccgacctctcaacaagccaaggaccgggtgaaggaccgcttccgcatcgccgacggcctcttcgaagcgtacatgcctagcttccgcgtgagcggctatgaagtgccattgctcaccgtatatgcggcggcggccaacctgcacctcctcctcctccgcgactgctctatctacggcattcagtggggtttctcccagaccaatgtcaacgagaactataatcggcagatccgtcacaccgccgagtacgcgaaccactgcacgacatggtaccagacgggcctggagcgactgcgcggcacgaacgcctcaagctgggtgccgtacaaccgtttcaggagagagatgactctcaccgtgctcgacatctgcagtctgttctccaactatgactacaggagttacccggcagaggtgcgggctgagctgaccagggagatatacacggacccggtggtcagcacctctctgtgggtgaacaacgcgccgtccttcggcgaaatcgagaatctggcaatccgagcgccacgcaccgtgacatggctcaattcgacgcgtattagcactggcacactccaaggttggtctgggtccaacaggtactgggccgcccacatgcagaacttctcggagactaactccggcaacataggcttcgacggcccgctgtacgggtccactgtgggtacaatcattcgcgatgacaattacgagatggtcaaccgggacatttacaccatcacttcggaggcggttgcggctttgtggcccacgggccagattgtgctgggcgtggcttccgcaagattcacccttcgaaacctcaacaacaacctgacccaggcgctggtctacgagaacccgatatcaagcagtttcaaccggtcaactctcacacgcgagttgccgggcgagaacagcgacaggcccacctcttcggactactcccaccgtctcactagcatcactgcgttccgcgcaggcagtaacggtacgattcctgtgttcggctggaccagtatctccgtcaacagggacaacatactggagcggaacaagatcacccagttccctggcgttaagtcccataccctgaacaattgccaggtcgtccgcggtacaggctttaccggcggcgactggcttcggcctaacaacaacgggtcgttccgattgactatcacctcgttcagctcacagagttacagaatcaggctgcggtacgcgtccgcagcgaatacctccctgcgaatctcgtcttcggcggccgggatctcgtcaacaaccgtcccactcgcctccacgatcactagcctcccgcagacagccgtcccatacgaggcgttccgggtgatcgacctgccaatcacgttcaccaccgcgacgcagtctaactacactttcgacttcgtcctccagaatccttccaacgccaacgtgttcatcgaccgcttcgagtttgtcccgattggaggttcgctctcagagtacgagacgaagtga

SEQ ID NO: 81 - protein, 611 aa, Artificial
  The amino acid sequence of the CR-BREla.TIC7381_3.nno_Mc:1 protein, comprising an N-terminal and C-terminal truncation, an additional alanine residue, and comprises amino acids 50 through 658 of TICTIC7381.
MATDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWVNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNILERNKITQFPGVKSHTLNNCQVVRGTGFTGGDWLRPNNNGSFRLTITSFSSQSYRIRLRYASAANTSLRISSSAAGISSTTVPLASTITSLPQTAVPYEAFRVIDLPITFTTATQSNYTFDFVLQNPSNANVFIDRFEFVPIGGSLSEYETK

SEQ ID NO: 82 - DNA, 1833 bp, Artificial
  A synthetic coding sequence used for expression in plants encoding a CR-BREla.TIC7382_3.nno_Mc:1 protein with an N-terminal and C-terminal truncation, and an additional alanine codon after the intiating methionine relative to TIC7382.
atggccactaacaattacaccgacgcgctccagtctccggaagccacagccatttcgaagggggcggtctcggcggcgatcagcatcagcaccaaggtgctcggcctcctcggcgtgccgttcgcggctcagataggacagctctggacattcattctgaacgccctgtggccgtccgacaacacccagtgggaggagttcatgcggcacgtcgaggagctcatcaaccagcggatcgcagactatgcccgtaacaaggccctggccgagctgacgggactcggcaacaacctcgacctctacatcgaggccctggatgactggaagaggaaccccaccagccaggaggccaagactcgcgtcatcgaccgcttccgcatcgtcgacgggctgttcgaggcctacattccgagcttcgccgtgagcggctatcaagttcagctgctcactgtctacgccgctgcagcaaacctccacctcctgctgctgcgcgactccacgatctacggaatcgactggggcctttcccagactaacgtcaacgataactacaaccggcagattcgtctcaccgcgacgtacgctaaccactgtacaacgtggtaccagacaggactggagcggctccgcgggagcaacgcgtcttcctgggtgacctacaaccgtttccggagagagatgactctcacagtcttggacatctgttccttgttcagcaactacgactatcgcagctacccggccgaggttcgcggcgagattacgagggaaatctacacagaccctgtcggcgtcggttgggttgacagcgcgccttctttcggcgagatcgagaacctggcgatccgggcgccacggactgtgacctggctgaactccacccggatctccaccggcaccttaagcggctggtcgggctctaaccggtactgggcggcccacatgcagaatttctccgagacaaactcgggtaacatcggcttcgatgggccgctgtacgggagcacagtgggcaccatccaccgcactgatgactacgacatgggcaaccgggacatctacacgataacgtcgcaggccgttctcggtctgtggcccacgggccagcgggtcctgggagtcgcatctgcgcgtttcaccctcaggaacctattcaataacctgacccaggtgctggtatacgagaatcctattagctccaacttcggctcttcaacgctaacccacgagttatccggcgagaacagcgataggcccaccagcagcgattactcacatcgactcacaagcatcacgggattccgcgcaggagcaaatggtaccgttcccgtctttgggtggaccagcgccacagtcgaccggaacaacatcatcgagcgcaacaagatcacgcagttcccaggcgtcaaatcgcacacgctaaacaactgccaggtggtgaggggaaccggtttcaccggaggtgactggttaagaccaaataacaacggcactttccgcctcactattacgagcttctcctcccaaagttaccgcatccgccttcgctacgccacgtcagtggggaacacctcgctggtgatatcctcctcagacgccgggatcagcagcaccacgataccactaacatccacaataacctcattgccgcagacggtcccgtatcaggccttcagagtggtggaccttcctattacgttcacgacgcccacgacccagcgcaactacacattcgatttccggttgcagaacccgagtaacgccaatgtcttcatcgatcgtttcgagttcgtcccgataggcggctccctttcggagtacgaaacgaagtga

SEQ ID NO: 83 - protein, 610 aa, Artificial
  The amino acid sequence of the CR-BREla.TIC7382_3.nno_Mc:1 protein, with an N-terminal and C-terminal truncation, an additional alanine residue, and comprises amino acids 52 through 659 of TIC7382.
MATNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNIIERNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETK

SEQ ID NO: 84 - DNA, 1968 bp, Artificial
  A synthetic coding sequence used for expression in a plant cell encoding a CR-BREla.TIC7383_19.nno_Mc:1 protein, with an N-terminal and C-terminal truncation relative to the TIC7383 protein.
atgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 85 - protein, 655 aa, Artificial
  The amino acid sequence of the CR-BREla.TIC7383_19.nno_Mc:1 protein, and comprises amino acids 15 through 668 of TIC7383.
MQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 86 - DNA, 1947 bp, Artificial
  A synthetic coding sequence used for expression in plant cells encoding a CR-BREla.TIC7383_20.nno_Mc:1 protein, with an N-terminal and C-terminal truncation relative to the TIC7383 protein.
atgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 87 - protein, 648 aa, Artificial
  The amino acid sequence of the CR-BREla.TIC7383_20.nno_Mc:1 protein, and comprises amino acids 15 through 661 of TIC7383.
MQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 88 - DNA, 1833 bp, Artificial
  A synthetic coding sequence used for expression in a plant cell, encoding a CR-BREla.TIC7383_21.nno_Mc:1 protein with an N-terminal and C-terminal truncation, and an additional alanine codon after the intiating methionine relative to TIC7383.
atggctaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 89 - protein, 610 aa, Artificial
  The amino acid sequence of the CR-BREla.TIC7383_21.nno_Mc:1 protein, with an N-terminal and C-terminal truncation, an additional alanine residue, and comprises amino acids 54 through 661 of TIC7383.
MATDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 90 - DNA, 1851 bp, Artificial
  A synthetic coding sequence used for expression in plant cells, encoding a CR-BREla.TIC7383_22.nno_Mc:1 protein, with an N-terminal and C-terminal truncation relative to the TIC7383 protein.
atgaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 91 - protein, 616 aa, Artificial
  The amino acid sequence of the CR-BREla.TIC7383_22.nno_Mc:1 protein, and comprises amino acids 54 through 668 of TIC7383.
MTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 92 - DNA, 1830 bp, Artificial
  A synthetic coding sequence used for expression in a plant cell encoding a CR-BREla.TIC7383_23.nno_Mc:1 protein, with an N-terminal and C-terminal truncation relative to the TIC7383 protein.
atgaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 93 - protein, 609 aa, Artificial
  The amino acid sequence of the CR-BREla.TIC7383_23.nno_Mc:1 protein, and comprises amino acids 54 through 661 of TIC7383.
MTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 94 - DNA, 1773 bp, Artificial
  A synthetic coding sequence used for expression in a plant cell encoding a CR-BREla.TIC7383_24.nno_Mc:2 protein, with an N-terminal and C-terminal truncation relative to the TIC7383 protein.
atggccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 95 - protein, 590 aa, Artificial
  The amino acid sequence of the CR-BREla.TIC7383_24.nno_Mc:2 protein, and comprises amino acids 73 through 661 of TIC7383.
MAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 96 - DNA, 1710 bp, Artificial
  A synthetic coding sequence used for expression in a plant cell encoding a CR-BREla.TIC7383_25.nno_Mc:3 protein, with N-terminal and C-terminal truncation relative to the TIC7383 protein.
atggcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 97 - protein, 569 aa, Artificial
  The amino acid sequence of the CR-BREla.TIC7383_25.nno_Mc:3 protein, and comprises amino acids 94 through 661 of TIC7383.
MAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 98 - DNA, 1650 bp, Artificial
  A synthetic coding sequence used for expression in a plant cell encoding a CR-BREla.TIC7383_26.nno_Mc:1 protein, with an N-terminal and C-terminal truncation relative to the TIC7383 protein.
atgcagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcatga

SEQ ID NO: 99 - protein, 549 aa, Artificial
  The amino acid sequence of the CR-BREla.TIC7383_26.nno_Mc:1 protein, and comprises amino acids 114 through 661 of TIC7383.
MQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSS

SEQ ID NO: 100 - DNA, 1824 bp, Artificial
  A synthetic coding sequence used for expression in a plant cell encoding a CR-BREla.TIC7383_27.nno_Mc:1 protein, with an N-terminal and C-terminal truncation, and an additional alanine codon after the initiating methionine, relative to TIC7383.
atggctaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgtga

SEQ ID NO: 101 - protein, 607 aa, Artificial
  The amino acid sequence of the CR-BREla.TIC7383_27.nno_Mc:1 protein, with an N-terminal and C-terminal truncation, an additional alanine residue, and comprises amino acids 54 through 658 of TIC7383.
MATDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPV

SEQ ID NO: 102 - DNA, 1938 bp, Artificial
  A synthetic coding sequence used for expression in a plant cell encoding a CR-BREla.TIC7383_28.nno_Mc:1 protein with an N-terminal and C-terminal truncation relative to the TIC7383 protein.
atgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgtga

SEQ ID NO: 103 - protein, 645 aa, Artificial
  The amino acid sequence of the CR-BREla.TIC7383_28.nno_Mc:1 protein, and comprises amino acids 15 through 658 of TIC7383.
MQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPV

SEQ ID NO: 104 - DNA, 2895 bp, Artificial
  A synthetic coding sequence used for expression in a plant cell encoding a CR-BREla.TIC7383_29.nno_Mc:1 protein with, and an additional alanine codon, and a C-terminal truncation relative to the TIC7383 protein.
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagcacgagcttgaaaaggcgaaaaaagcagttaacgacctcttcacgaacgagtccaaaaacatgttaaagaaagacacgaccgactacgacatcgaccaggctgcggacctggtggagtgcgtaagcgacgagtgcgcccacgctaagatgatactgctggacgaagtgaagtacgcgaagcagctgagcgaggctcggaacctgctccagaacgggaacttcaaggtcttagacgttgacaacaacaacccgtggacgacctcaccgaacgtaacgatccaggagaacaacccgatcttcaaaggtcactacctctccatgtccggtgcgaacgcaatcgaggccaccaacgaggtgttcccaacgtacgtgtaccaaaagattgaggagagtaaactcaagccctacacaaggtacaaggtgcgggggttcatcggccagagcaaggacgtcgagctgctcgtcacgcgttacgacgaggaggtggacgctattctgaacgtgcctaacgacctaaagtacgcagtgccgacgcacctgtcgggagagttcaaccgctgcaagcctcacacttacccggccacagacccccgatgccacgacgacgtgatcgacaagatcgacatctcctcgccgtgtcagaacaacattatgctgtcggacgcggacatctctagtcttcatagcggacttggcaagaagcacgggatctgccacgagagccatcacttcgagttccacatcgacacgggcaaaatcgacctcgtggagaaccttggcatctgggtgatcttcaagatctgctctaccgacggatacgcgacgctcgacaatctggaagtaatagaggaaggcccgttgggcgcagagtccctagagcgggtgtag

SEQ ID NO: 105 - protein, 964 aa, Artificial
  The amino acid sequence of the CR-BREla.TIC7383_29.nno_Mc:1 protein, with an additional alanine residue, and comprises amino acids 1 through 963 of TIC7383.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERV

SEQ ID NO: 106 - DNA, 3774 bp, Artificial
  A synthetic coding sequence used for expression in a plant cell encoding a CR-BREla.TIC7383_30.nno_Mc:1 protein, comprising an additional alanine codon, and mutations to the codons corresponding amino acid positions 964, 966, and 968 relative to
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagcacgagcttgaaaaggcgaaaaaagcagttaacgacctcttcacgaacgagtccaaaaacatgttaaagaaagacacgaccgactacgacatcgaccaggctgcggacctggtggagtgcgtaagcgacgagtgcgcccacgctaagatgatactgctggacgaagtgaagtacgcgaagcagctgagcgaggctcggaacctgctccagaacgggaacttcaaggtcttagacgttgacaacaacaacccgtggacgacctcaccgaacgtaacgatccaggagaacaacccgatcttcaaaggtcactacctctccatgtccggtgcgaacgcaatcgaggccaccaacgaggtgttcccaacgtacgtgtaccaaaagattgaggagagtaaactcaagccctacacaaggtacaaggtgcgggggttcatcggccagagcaaggacgtcgagctgctcgtcacgcgttacgacgaggaggtggacgctattctgaacgtgcctaacgacctaaagtacgcagtgccgacgcacctgtcgggagagttcaaccgctgcaagcctcacacttacccggccacagacccccgatgccacgacgacgtgatcgacaagatcgacatctcctcgccgtgtcagaacaacattatgctgtcggacgcggacatctctagtcttcatagcggacttggcaagaagcacgggatctgccacgagagccatcacttcgagttccacatcgacacgggcaaaatcgacctcgtggagaaccttggcatctgggtgatcttcaagatctgctctaccgacggatacgcgacgctcgacaatctggaagtaatagaggaaggcccgttgggcgcagagtccctagagcgggtggcacgtgcggaggctaagtggaagcataacatggagcacaagtgctcggaaacgaaacacgcataccacgcggcgaagcaggctgtcgaagcactcttcacgaacttcaaggacgagaggctcaagttcgagacgacgattagtaacatcctgtcagctgagtacctagtccagtccatcccatacgtctacaacaagtggctgtcggacgtacctgggatgaactacgacatctacaccgagctcaagaaccgcatctggcaagcgttcaacttgtacgaccagaggaacatcatcaagaacggccacttcaatcatggtttaatgcattggcacgcgacaccgcacgcgaacgtgcagcaaatagacggtatttccgtgctggtcctcccaaactggggggccaacgtcagccaggaggtgtgcctcaagcacaaccggggctacgtgctgcgagtcacggccaaggaggagggtcacggcaagggctacgtgacgatttcggactgcgctaaccaggtcgagaagctgtcgttcactagccgcgactactctaccgacggcgtcccatacgaacagtccaactacccgaccgacggagtgtcttacgggcagcacgggtgcaacatcgaccgagtgccctacgagcaatctggctaccccaccgacggggttccttacgaacagtcgggctaccgtacggacggggtcccgtacaagcagcatggatgccactcggacggaagccgtgaggagcagcacgggtacgttacgaagactatcgacgtcttccccgacacggacaaggtccggatcgacatcggcgagaccgaggggacgttcaaggttgagagcgtggagctcatctgcatggaggagtag

SEQ ID NO: 107 - protein, 1257 aa, Artificial
  The amino acid sequence of the CR-BREla.TIC7383_30.nno_Mc:1 protein, with an additional alanine residue, and comprises the mutations, K964A; R966A; K968A, relative to TIC7383.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERVARAEAKWKHNMEHKCSETKHAYHAAKQAVEALFTNFKDERLKFETTISNILSAEYLVQSIPYVYNKWLSDVPGMNYDIYTELKNRIWQAFNLYDQRNIIKNGHFNHGLMHWHATPHANVQQIDGISVLVLPNWGANVSQEVCLKHNRGYVLRVTAKEEGHGKGYVTISDCANQVEKLSFTSRDYSTDGVPYEQSNYPTDGVSYGQHGCNIDRVPYEQSGYPTDGVPYEQSGYRTDGVPYKQHGCHSDGSREEQHGYVTKTIDVFPDTDKVRIDIGETEGTFKVESVELICMEE

SEQ ID NO: 108 - DNA, 3201 bp, Artificial
  A synthetic coding sequence used for expression in a plant cell encoding a CR-BREla.TIC7383_31.nno_Mc:1 protein with an alanine codon, C-terminal truncation, and mutations to the codons corresponding amino acid positions 964, 966, and 968 relative to
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagcacgagcttgaaaaggcgaaaaaagcagttaacgacctcttcacgaacgagtccaaaaacatgttaaagaaagacacgaccgactacgacatcgaccaggctgcggacctggtggagtgcgtaagcgacgagtgcgcccacgctaagatgatactgctggacgaagtgaagtacgcgaagcagctgagcgaggctcggaacctgctccagaacgggaacttcaaggtcttagacgttgacaacaacaacccgtggacgacctcaccgaacgtaacgatccaggagaacaacccgatcttcaaaggtcactacctctccatgtccggtgcgaacgcaatcgaggccaccaacgaggtgttcccaacgtacgtgtaccaaaagattgaggagagtaaactcaagccctacacaaggtacaaggtgcgggggttcatcggccagagcaaggacgtcgagctgctcgtcacgcgttacgacgaggaggtggacgctattctgaacgtgcctaacgacctaaagtacgcagtgccgacgcacctgtcgggagagttcaaccgctgcaagcctcacacttacccggccacagacccccgatgccacgacgacgtgatcgacaagatcgacatctcctcgccgtgtcagaacaacattatgctgtcggacgcggacatctctagtcttcatagcggacttggcaagaagcacgggatctgccacgagagccatcacttcgagttccacatcgacacgggcaaaatcgacctcgtggagaaccttggcatctgggtgatcttcaagatctgctctaccgacggatacgcgacgctcgacaatctggaagtaatagaggaaggcccgttgggcgcagagtccctagagcgggtggcacgtgcggaggctaagtggaagcataacatggagcacaagtgctcggaaacgaaacacgcataccacgcggcgaagcaggctgtcgaagcactcttcacgaacttcaaggacgagaggctcaagttcgagacgacgattagtaacatcctgtcagctgagtacctagtccagtccatcccatacgtctacaacaagtggctgtcggacgtacctgggatgaactacgacatctacaccgagctcaagaaccgcatctggcaagcgttcaacttgtacgaccagaggaacatcatcaagaacggctag

SEQ ID NO: 109 - protein, 1066 aa, Artificial
  The amino acid sequence of the CR-BREla.TIC7383_31.nno_Mc:1 protein, with an additional alanine residue, and comprising amino acids 1 through 1065, and also comprises the mutations, K964A; R966A; K968A, relative to TIC7383.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERVARAEAKWKHNMEHKCSETKHAYHAAKQAVEALFTNFKDERLKFETTISNILSAEYLVQSIPYVYNKWLSDVPGMNYDIYTELKNRIWQAFNLYDQRNIIKNG

SEQ ID NO: 110 - DNA, 3756 bp, Artificial
  A synthetic coding sequence used for expression in a plant cell encoding a CR-BREla.TIC7383_32.nno_Mc:1 protein comprising an additional alanine codon, and a deletion of the codons corresponding amino acid positions 964 through 969 relative to
atggctaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagcacgagcttgaaaaggcgaaaaaagcagttaacgacctcttcacgaacgagtccaaaaacatgttaaagaaagacacgaccgactacgacatcgaccaggctgcggacctggtggagtgcgtaagcgacgagtgcgcccacgctaagatgatactgctggacgaagtgaagtacgcgaagcagctgagcgaggctcggaacctgctccagaacgggaacttcaaggtcttagacgttgacaacaacaacccgtggacgacctcaccgaacgtaacgatccaggagaacaacccgatcttcaaaggtcactacctctccatgtccggtgcgaacgcaatcgaggccaccaacgaggtgttcccaacgtacgtgtaccaaaagattgaggagagtaaactcaagccctacacaaggtacaaggtgcgggggttcatcggccagagcaaggacgtcgagctgctcgtcacgcgttacgacgaggaggtggacgctattctgaacgtgcctaacgacctaaagtacgcagtgccgacgcacctgtcgggagagttcaaccgctgcaagcctcacacttacccggccacagacccccgatgccacgacgacgtgatcgacaagatcgacatctcctcgccgtgtcagaacaacattatgctgtcggacgcggacatctctagtcttcatagcggacttggcaagaagcacgggatctgccacgagagccatcacttcgagttccacatcgacacgggcaaaatcgacctcgtggagaaccttggcatctgggtgatcttcaagatctgctctaccgacggatacgcgacgctcgacaatctggaagtaatagaggaaggcccgttgggcgcagagtccctagagcgggtgtggaagcataacatggagcacaagtgctcggaaacgaaacacgcataccacgcggcgaagcaggctgtcgaagcactcttcacgaacttcaaggacgagaggctcaagttcgagacgacgattagtaacatcctgtcagctgagtacctagtccagtccatcccatacgtctacaacaagtggctgtcggacgtacctgggatgaactacgacatctacaccgagctcaagaaccgcatctggcaagcgttcaacttgtacgaccagaggaacatcatcaagaacggccacttcaatcatggtttaatgcattggcacgcgacaccgcacgcgaacgtgcagcaaatagacggtatttccgtgctggtcctcccaaactggggggccaacgtcagccaggaggtgtgcctcaagcacaaccggggctacgtgctgcgagtcacggccaaggaggagggtcacggcaagggctacgtgacgatttcggactgcgctaaccaggtcgagaagctgtcgttcactagccgcgactactctaccgacggcgtcccatacgaacagtccaactacccgaccgacggagtgtcttacgggcagcacgggtgcaacatcgaccgagtgccctacgagcaatctggctaccccaccgacggggttccttacgaacagtcgggctaccgtacggacggggtcccgtacaagcagcatggatgccactcggacggaagccgtgaggagcagcacgggtacgttacgaagactatcgacgtcttccccgacacggacaaggtccggatcgacatcggcgagaccgaggggacgttcaaggttgagagcgtggagctcatctgcatggaggagtag

SEQ ID NO: 111 - protein, 1251 aa, Artificial
  The the amino acid sequence of the CR-BREla.TIC7383_32.nno_Mc:1 protein, with an additional alanine residue, and comprising a deletion of amino acids 964 through 969 relative to TIC7383.
MANQNQNQNQNKNELQIIEPSSDSLLYSHNNYPYATDPNTVLEGRNYKEWLNKCTDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETKHELEKAKKAVNDLFTNESKNMLKKDTTDYDIDQAADLVECVSDECAHAKMILLDEVKYAKQLSEARNLLQNGNFKVLDVDNNNPWTTSPNVTIQENNPIFKGHYLSMSGANAIEATNEVFPTYVYQKIEESKLKPYTRYKVRGFIGQSKDVELLVTRYDEEVDAILNVPNDLKYAVPTHLSGEFNRCKPHTYPATDPRCHDDVIDKIDISSPCQNNIMLSDADISSLHSGLGKKHGICHESHHFEFHIDTGKIDLVENLGIWVIFKICSTDGYATLDNLEVIEEGPLGAESLERVWKHNMEHKCSETKHAYHAAKQAVEALFTNFKDERLKFETTISNILSAEYLVQSIPYVYNKWLSDVPGMNYDIYTELKNRIWQAFNLYDQRNIIKNGHFNHGLMHWHATPHANVQQIDGISVLVLPNWGANVSQEVCLKHNRGYVLRVTAKEEGHGKGYVTISDCANQVEKLSFTSRDYSTDGVPYEQSNYPTDGVSYGQHGCNIDRVPYEQSGYPTDGVPYEQSGYRTDGVPYKQHGCHSDGSREEQHGYVTKTIDVFPDTDKVRIDIGETEGTFKVESVELICMEE

SEQ ID NO: 112 - DNA, 1854 bp, Artificial
  A synthetic coding sequence used for expression in a plant cell encoding a GOI-TIC10743.nno_Mc:1 chimeric protein comprised of domains one and two of TIC7383 and domain three of TIC7042.
atggctaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaacatcatcgagcagaacaagatcacccagttccctggcgttaagtcacacactcttaacaactgtcaagtggtgcgtggcaccgggttcaccggcggcgactggcttcgcccaaacaacaatggcacctttcggctgaccattaccagcttctcgtcccagtcctaccgcatcaggcttcgatacgctaccagcgtcggcaacacctctcttgtcatctcgtcatccgacgcgggcatctccagtaccacaatccctctgacatccaccatcacgtcgctcccgcagaccgttccgtaccaggcgttccgcgtcgtcgatctcccgatcactttcactactccgaccactcagcgcaattacaccttcgatttccgcctccagaacccgagcaacgctaacgtattcatcgaccgcttcgagttcgtaccaatcggcggctcactgtccgagtacgagacgaagtga

SEQ ID NO: 113 - protein, 617 aa, Artificial
  The amino acid sequence of the GOI-TIC10743.nno_Mc:1 chimeric protein.
MATDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNIIEQNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETK

SEQ ID NO: 114 - DNA, 1851 bp, Artificial
  A synthetic coding sequence used for expression in a plant cell encoding a GOI-TIC10744.nno_Mc:1 chimeric protein comprised of domains one and two of TIC7383 and domain three of TIC7381.
atggctaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaacatactggagcggaacaagatcacccagttccctggcgttaagtcccataccctgaacaattgccaggtcgtccgcggtacaggctttaccggcggcgactggcttcggcctaacaacaacgggtcgttccgattgactatcacctcgttcagctcacagagttacagaatcaggctgcggtacgcgtccgcagcgaatacctccctgcgaatctcgtcttcggcggccgggatctcgtcaacaaccgtcccactcgcctccacgatcactagcctcccgcagacagccgtcccatacgaggcgttccgggtgatcgacctgccaatcacgttcaccaccgcgacgcagtctaactacactttcgacttcgtcctccagaatccttccaacgccaacgtgttcatcgaccgcttcgagtttgtcccgattggaggttcgctctcagagtacgagacgaagtga

SEQ ID NO: 115 - protein, 616 aa, Artificial
  The amino acid sequence of the GOI-TIC10744.nno_Mc:1 chimeric protein.
MATDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNILERNKITQFPGVKSHTLNNCQVVRGTGFTGGDWLRPNNNGSFRLTITSFSSQSYRIRLRYASAANTSLRISSSAAGISSTTVPLASTITSLPQTAVPYEAFRVIDLPITFTTATQSNYTFDFVLQNPSNANVFIDRFEFVPIGGSLSEYETK

SEQ ID NO: 116 - DNA, 1854 bp, Artificial
  A synthetic coding sequence used for expression in a plant cell encoding a GOI-TIC10745.nno_Mc:1 chimeric protein comprised of domains one and two of TIC7383 and domain three of TIC7382.
atggctaccgacaactacaccgacgcactccagggcccggaggcgacggccatcagcaagggtgccgtctccgcggccatctccatctcgacgaaggtcctagggctcctaggggtcccgttcgctgcgcagattggccagctgtggacgttcatccttaacgcactctggccctcagacaacacccagtgggaggagttcatgcgccacgtcgaggaactgatcaaccagcgcatagcggactacgcgaggaacaaggccctggccgagctgacagggctgggcaacaacctagacctctacatcgaggcgctcgaggactggaagcggaaccctacctcccaacaagctaaggaccgcgttatcgaccgcttccgaatcgcggacggcctcttcgaggggtacatgccgagcttccgggtctcgggctacgaggtgcccctcctcacggtgtacgcggcggcggctaatttgcatctcctgctgctcagggattgctcgatctacggaatccagtggggcttctcccagactaacgttaacgagaactacaatcggcagattcggcacaccgccgagtacgctaaccactgcacaacatggtatcagaccggcctcgagaggctgcgcggcaccaatgctttctcatggatcaactacaaccgcttccgccgcgagatgacactgactgtcttggacgtctgctccctcttctccaactatgactaccgcacttaccccactgaggtccgggccgagcttacgcgggagatctacacagaccccatcgggttccagaactccccgctccctggcgtggtccccaattggtacgactacgcgaggtcgttcgcggaaatcgaaaacatcgccatacgagcacctcggacagtcacgtggctgaactcaaccaccatctacaccgggagactgaacggctacaacaatagcaactactactgggccgggttccgccagaacttctcagagaccaactctggcagcagcttcaacggcccagacctaggcgacctcactccgaactacaggatagagaccctcgacatggtcaacagggacatctacagcatctactcccgggtcgtgtcgcaatcctggcccatcggcaacgtcaagctcttcggcgtaagctcctctaccttaagtttccgggatctcaacaacaacagctccggcaccctggtctacgagaacccgactaacttcagctcccagtacctaaccacagagtttccaggggagaactccgagcggcccaccttcacggactacagtcaccgcctaacctgccttacgcggatcggggccgggaactacggcctcgtgctttgtgcgggttggacttcttcgagtgtcgaaagggacaacatcatcgagcgcaacaagatcacgcagttcccaggcgtcaaatcgcacacgctaaacaactgccaggtggtgaggggaaccggtttcaccggaggtgactggttaagaccaaataacaacggcactttccgcctcactattacgagcttctcctcccaaagttaccgcatccgccttcgctacgccacgtcagtggggaacacctcgctggtgatatcctcctcagacgccgggatcagcagcaccacgataccactaacatccacaataacctcattgccgcagacggtcccgtatcaggccttcagagtggtggaccttcctattacgttcacgacgcccacgacccagcgcaactacacattcgatttccggttgcagaacccgagtaacgccaatgtcttcatcgatcgtttcgagttcgtcccgataggcggctccctttcggagtacgaaacgaagtga

SEQ ID NO: 117 - protein, 617 aa, Artificial
  The amino acid sequence of the GOI-TIC10745.nno_Mc:1 chimeric protein.
MATDNYTDALQGPEATAISKGAVSAAISISTKVLGLLGVPFAAQIGQLWTFILNALWPSDNTQWEEFMRHVEELINQRIADYARNKALAELTGLGNNLDLYIEALEDWKRNPTSQQAKDRVIDRFRIADGLFEGYMPSFRVSGYEVPLLTVYAAAANLHLLLLRDCSIYGIQWGFSQTNVNENYNRQIRHTAEYANHCTTWYQTGLERLRGTNAFSWINYNRFRREMTLTVLDVCSLFSNYDYRTYPTEVRAELTREIYTDPIGFQNSPLPGVVPNWYDYARSFAEIENIAIRAPRTVTWLNSTTIYTGRLNGYNNSNYYWAGFRQNFSETNSGSSFNGPDLGDLTPNYRIETLDMVNRDIYSIYSRVVSQSWPIGNVKLFGVSSSTLSFRDLNNNSSGTLVYENPTNFSSQYLTTEFPGENSERPTFTDYSHRLTCLTRIGAGNYGLVLCAGWTSSSVERDNIIERNKITQFPGVKSHTLNNCQVVRGTGFTGGDWLRPNNNGTFRLTITSFSSQSYRIRLRYATSVGNTSLVISSSDAGISSTTIPLTSTITSLPQTVPYQAFRVVDLPITFTTPTTQRNYTFDFRLQNPSNANVFIDRFEFVPIGGSLSEYETK

SEQ ID NO: 118 - DNA, 1833 bp, Artificial
  A synthetic coding sequence used for expression in a plant cell encoding a GOI-TIC10746.nno_Mc:1 chimeric protein comprised of domains one and two of TIC7382 and domain three of TIC7383.
atggccactaacaattacaccgacgcgctccagtctccggaagccacagccatttcgaagggggcggtctcggcggcgatcagcatcagcaccaaggtgctcggcctcctcggcgtgccgttcgcggctcagataggacagctctggacattcattctgaacgccctgtggccgtccgacaacacccagtgggaggagttcatgcggcacgtcgaggagctcatcaaccagcggatcgcagactatgcccgtaacaaggccctggccgagctgacgggactcggcaacaacctcgacctctacatcgaggccctggatgactggaagaggaaccccaccagccaggaggccaagactcgcgtcatcgaccgcttccgcatcgtcgacgggctgttcgaggcctacattccgagcttcgccgtgagcggctatcaagttcagctgctcactgtctacgccgctgcagcaaacctccacctcctgctgctgcgcgactccacgatctacggaatcgactggggcctttcccagactaacgtcaacgataactacaaccggcagattcgtctcaccgcgacgtacgctaaccactgtacaacgtggtaccagacaggactggagcggctccgcgggagcaacgcgtcttcctgggtgacctacaaccgtttccggagagagatgactctcacagtcttggacatctgttccttgttcagcaactacgactatcgcagctacccggccgaggttcgcggcgagattacgagggaaatctacacagaccctgtcggcgtcggttgggttgacagcgcgccttctttcggcgagatcgagaacctggcgatccgggcgccacggactgtgacctggctgaactccacccggatctccaccggcaccttaagcggctggtcgggctctaaccggtactgggcggcccacatgcagaatttctccgagacaaactcgggtaacatcggcttcgatgggccgctgtacgggagcacagtgggcaccatccaccgcactgatgactacgacatgggcaaccgggacatctacacgataacgtcgcaggccgttctcggtctgtggcccacgggccagcgggtcctgggagtcgcatctgcgcgtttcaccctcaggaacctattcaataacctgacccaggtgctggtatacgagaatcctattagctccaacttcggctcttcaacgctaacccacgagttatccggcgagaacagcgataggcccaccagcagcgattactcacatcgactcacaagcatcacgggattccgcgcaggagcaaatggtaccgttcccgtctttgggtggaccagcgccacagtcgaccggaacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 119 - protein, 610 aa, Artificial
  The amino acid sequence of the GOI-TIC10746.nno_Mc:1 chimeric protein.
MATNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 120 - DNA, 1839 bp, Artificial
  A synthetic coding sequence used for expression in a plant cell encoding a GOI-TIC10747.nno_Mc:1 chimeric protein comprised of domains one and two of TIC7381 and domain three of TIC7383.
atggctacagacaactacaccgatgcactgcaaggcccagaggcaacggctatcagcaagggtgccgtgtcggccgctatctctatcagcaccaaagtcttgagccttctgggagtgcccttcgcagctcagattgggcaattgtggacgtttattctgaacgctctttggccctcggacaacacccagtgggaggagttcatgcgccatgtcgaggagctcatcaaccagcgtatcgccgactacgcgcggagtaaggcgctcgccgagctcacgggcctgggcaacaacctcgatctgtacatcgaagctcttgaggactggaagcgcaacccgacctctcaacaagccaaggaccgggtgaaggaccgcttccgcatcgccgacggcctcttcgaagcgtacatgcctagcttccgcgtgagcggctatgaagtgccattgctcaccgtatatgcggcggcggccaacctgcacctcctcctcctccgcgactgctctatctacggcattcagtggggtttctcccagaccaatgtcaacgagaactataatcggcagatccgtcacaccgccgagtacgcgaaccactgcacgacatggtaccagacgggcctggagcgactgcgcggcacgaacgcctcaagctgggtgccgtacaaccgtttcaggagagagatgactctcaccgtgctcgacatctgcagtctgttctccaactatgactacaggagttacccggcagaggtgcgggctgagctgaccagggagatatacacggacccggtggtcagcacctctctgtgggtgaacaacgcgccgtccttcggcgaaatcgagaatctggcaatccgagcgccacgcaccgtgacatggctcaattcgacgcgtattagcactggcacactccaaggttggtctgggtccaacaggtactgggccgcccacatgcagaacttctcggagactaactccggcaacataggcttcgacggcccgctgtacgggtccactgtgggtacaatcattcgcgatgacaattacgagatggtcaaccgggacatttacaccatcacttcggaggcggttgcggctttgtggcccacgggccagattgtgctgggcgtggcttccgcaagattcacccttcgaaacctcaacaacaacctgacccaggcgctggtctacgagaacccgatatcaagcagtttcaaccggtcaactctcacacgcgagttgccgggcgagaacagcgacaggcccacctcttcggactactcccaccgtctcactagcatcactgcgttccgcgcaggcagtaacggtacgattcctgtgttcggctggaccagtatctccgtcaacagggacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 121 - protein, 612 aa, Artificial
  The amino acid sequence of the GOI-TIC10747.nno_Mc:1 chimeric protein.
MATDNYTDALQGPEATAISKGAVSAAISISTKVLSLLGVPFAAQIGQLWTFILNALWPSDNTQWEEFMRHVEELINQRIADYARSKALAELTGLGNNLDLYIEALEDWKRNPTSQQAKDRVKDRFRIADGLFEAYMPSFRVSGYEVPLLTVYAAAANLHLLLLRDCSIYGIQWGFSQTNVNENYNRQIRHTAEYANHCTTWYQTGLERLRGTNASSWVPYNRFRREMTLTVLDICSLFSNYDYRSYPAEVRAELTREIYTDPVVSTSLWVNNAPSFGEIENLAIRAPRTVTWLNSTRISTGTLQGWSGSNRYWAAHMQNFSETNSGNIGFDGPLYGSTVGTIIRDDNYEMVNRDIYTITSEAVAALWPTGQIVLGVASARFTLRNLNNNLTQALVYENPISSSFNRSTLTRELPGENSDRPTSSDYSHRLTSITAFRAGSNGTIPVFGWTSISVNRDNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 122 - DNA, 1830 bp, Artificial
  A synthetic coding sequence used for expression in  a plant cell encoding a GOI-TIC10748.nno_Mc:1 chimeric protein comprised of domains one and two of TIC7042 and domain three of TIC7383.
atggcttgcaccgatacggacgactcgcgctcgcccgaggccgcgagcacggctcgcagcgcgatctccgtcgccatcaccattagcaccaccatcctgggactccttggagttcccttcgcgtcccagatcggtgccttctacaacttcgtgctcaacaccgtgtggcctcagggaaataaccagtgggaggagttcatgaggcacgtggagaacctcatcaacgagcgcattgctgactacgcgcgcgacaaagccttggccgagctgaccggcctgggcaacaacctgaatctctatcgggaggctttcgaggactggcggcggaacccgacctcccaggaagccaagactcgggtgatcgaccgctttcgtattctcgacggcctgttcgagacttacatgccctccttcgcggtccgcaactttgaggttcagctcctgactgtgtacgcctcggctgcaaacatacacctgttcctgctgcgggacagctcgatctacggtttggactggggcctgtcacagaccaacgtgaacgagaactacaaccggcagatccgccacgccgccacctatgcaaaccactgcaccacttggtatcagacagggctccagcgcctccagggcactaacgcaacgtcatgggttgcatacaaccggtttcggcgggagatgacactcaccgtgttggacatctgctcgctgttctccaactacgactaccggtcgtacccgactgaggtgaagggcgagttgaccagggaaatctacacagaccctgtcggccggaactggcagaacgtcgcgccttcattcgcggagattgagaacctgaccattcgcgctccgcgtaccgtcacttggctcaactccactcggatcttcacagggacgctgaccggctggtccgggtccaaccgctactgggccgcccacatgcagaacttcagcgagacaaactctggcaacatcggattcgatggcccacagtatgggtccacggtcgggacgatacaccggaccgacgactacgacatggtgaaccgggacatctacaccataacgagccaggcagtcgccgccctctggcccaccggccagacagtcctgggcgtggcgagcacccgcttcacactgaggaatctgaacaacaactcgacggaggcactcgtgtacgagaacgccatctcgtcctccttcgttagcagcactctcactcatgagctgccgggcgagaacagcgaccgcccaacgagcagcgattacagccaccgtctttcctccatcacgggcttccgggctggagccaacgggaccgtgcccgtgttcggttggaccagcgcgacagttgaccgtaacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 123 - protein, 609 aa, Artificial
  The amino acid sequence of the GOI-TIC10748.nno_Mc:1 chimeric protein.
MACTDTDDSRSPEAASTARSAISVAITISTTILGLLGVPFASQIGAFYNFVLNTVWPQGNNQWEEFMRHVENLINERIADYARDKALAELTGLGNNLNLYREAFEDWRRNPTSQEAKTRVIDRFRILDGLFETYMPSFAVRNFEVQLLTVYASAANIHLFLLRDSSIYGLDWGLSQTNVNENYNRQIRHAATYANHCTTWYQTGLQRLQGTNATSWVAYNRFRREMTLTVLDICSLFSNYDYRSYPTEVKGELTREIYTDPVGRNWQNVAPSFAEIENLTIRAPRTVTWLNSTRIFTGTLTGWSGSNRYWAAHMQNFSETNSGNIGFDGPQYGSTVGTIHRTDDYDMVNRDIYTITSQAVAALWPTGQTVLGVASTRFTLRNLNNNSTEALVYENAISSSFVSSTLTHELPGENSDRPTSSDYSHRLSSITGFRAGANGTVPVFGWTSATVDRNNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 124 - DNA, 1980 bp, Artificial
  A synthetic coding sequence used for expression in a plant cell encoding a TIC10746NTermExt1chimeric protein comprised of domains one and two of TIC7382, domain three of TIC7383, and the N-terminal extension of TIC7382.
atgaaccagaaccagaaccagaacaagaacgagatgcagatcatcgagccctcctccgactcattcctctactcgcacaacaactacccctacgcgacggaccccaacactgttctcgaagggcggaactacaaggagtggctaaacaagtgcactaacaattacaccgacgcgctccagtctccggaagccacagccatttcgaagggggcggtctcggcggcgatcagcatcagcaccaaggtgctcggcctcctcggcgtgccgttcgcggctcagataggacagctctggacattcattctgaacgccctgtggccgtccgacaacacccagtgggaggagttcatgcggcacgtcgaggagctcatcaaccagcggatcgcagactatgcccgtaacaaggccctggccgagctgacgggactcggcaacaacctcgacctctacatcgaggccctggatgactggaagaggaaccccaccagccaggaggccaagactcgcgtcatcgaccgcttccgcatcgtcgacgggctgttcgaggcctacattccgagcttcgccgtgagcggctatcaagttcagctgctcactgtctacgccgctgcagcaaacctccacctcctgctgctgcgcgactccacgatctacggaatcgactggggcctttcccagactaacgtcaacgataactacaaccggcagattcgtctcaccgcgacgtacgctaaccactgtacaacgtggtaccagacaggactggagcggctccgcgggagcaacgcgtcttcctgggtgacctacaaccgtttccggagagagatgactctcacagtcttggacatctgttccttgttcagcaactacgactatcgcagctacccggccgaggttcgcggcgagattacgagggaaatctacacagaccctgtcggcgtcggttgggttgacagcgcgccttctttcggcgagatcgagaacctggcgatccgggcgccacggactgtgacctggctgaactccacccggatctccaccggcaccttaagcggctggtcgggctctaaccggtactgggcggcccacatgcagaatttctccgagacaaactcgggtaacatcggcttcgatgggccgctgtacgggagcacagtgggcaccatccaccgcactgatgactacgacatgggcaaccgggacatctacacgataacgtcgcaggccgttctcggtctgtggcccacgggccagcgggtcctgggagtcgcatctgcgcgtttcaccctcaggaacctattcaataacctgacccaggtgctggtatacgagaatcctattagctccaacttcggctcttcaacgctaacccacgagttatccggcgagaacagcgataggcccaccagcagcgattactcacatcgactcacaagcatcacgggattccgcgcaggagcaaatggtaccgttcccgtctttgggtggaccagcgccacagtcgaccggaacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 125 - protein, 659 aa, Artificial
  The amino acid sequence of the TIC10746NTermExt1 chimeric protein.
MNQNQNQNKNEMQIIEPSSDSFLYSHNNYPYATDPNTVLEGRNYKEWLNKCTNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

SEQ ID NO: 126 - DNA, 1986 bp, Artificial
  A synthetic coding sequence used for expression in a plant cell encoding a TIC10746NTermExt2 chimeric protein comprised of domains one and two of TIC7382, domain three of TIC7383, and the N-terminal extension of TIC7383.
atgaaccagaaccagaaccaaaaccagaacaagaacgagctgcagatcattgaaccctcctcggacagcctcctgtacagccataacaactacccgtacgccactgacccaaacaccgtgctcgaggggcgcaactacaaggagtggctcaacaaatgcactaacaattacaccgacgcgctccagtctccggaagccacagccatttcgaagggggcggtctcggcggcgatcagcatcagcaccaaggtgctcggcctcctcggcgtgccgttcgcggctcagataggacagctctggacattcattctgaacgccctgtggccgtccgacaacacccagtgggaggagttcatgcggcacgtcgaggagctcatcaaccagcggatcgcagactatgcccgtaacaaggccctggccgagctgacgggactcggcaacaacctcgacctctacatcgaggccctggatgactggaagaggaaccccaccagccaggaggccaagactcgcgtcatcgaccgcttccgcatcgtcgacgggctgttcgaggcctacattccgagcttcgccgtgagcggctatcaagttcagctgctcactgtctacgccgctgcagcaaacctccacctcctgctgctgcgcgactccacgatctacggaatcgactggggcctttcccagactaacgtcaacgataactacaaccggcagattcgtctcaccgcgacgtacgctaaccactgtacaacgtggtaccagacaggactggagcggctccgcgggagcaacgcgtcttcctgggtgacctacaaccgtttccggagagagatgactctcacagtcttggacatctgttccttgttcagcaactacgactatcgcagctacccggccgaggttcgcggcgagattacgagggaaatctacacagaccctgtcggcgtcggttgggttgacagcgcgccttctttcggcgagatcgagaacctggcgatccgggcgccacggactgtgacctggctgaactccacccggatctccaccggcaccttaagcggctggtcgggctctaaccggtactgggcggcccacatgcagaatttctccgagacaaactcgggtaacatcggcttcgatgggccgctgtacgggagcacagtgggcaccatccaccgcactgatgactacgacatgggcaaccgggacatctacacgataacgtcgcaggccgttctcggtctgtggcccacgggccagcgggtcctgggagtcgcatctgcgcgtttcaccctcaggaacctattcaataacctgacccaggtgctggtatacgagaatcctattagctccaacttcggctcttcaacgctaacccacgagttatccggcgagaacagcgataggcccaccagcagcgattactcacatcgactcacaagcatcacgggattccgcgcaggagcaaatggtaccgttcccgtctttgggtggaccagcgccacagtcgaccggaacaaccgcctacaacccgataagattacccagtaccccgccgtcaaggggttcaacttggacggcttcacagtggtgaaagggactggtttcaccgggggcaactggctgcggtccagcagggtcaccgggtcattccgcctgaacgtatactcacctagtgtgcagacttatcggatgaggatcaggtacgcctccccgcttggcaactcgacgcttgggataagttcgacagacgccggcatctcgttcacgagtttccctctgccctccactatcgggagcatgccgtccactgtgccctacgaggcgttccgtgtcctcgacatccccatcacggtcaccgtagcctcccaaaggaactacaacttcatcttcgacatccttaacccctcggttggggccgtgtacatcgatcgtattgagttcgtgcccgtgggctcttcagtgttcgagtacgaaaccaagtga

SEQ ID NO: 127 - protein, 661 aa, Artificial
  The amino acid sequence of the TIC10746NTermExt2 chimeric protein.
MNQNQNQNQNKNELQIIEPSSDSLLYSHNNYPYATDPNTVLEGRNYKEWLNKCTNNYTDALQSPEATAISKGAVSAAISISTKVLGLLGVPFAAQIGQLWTFILNALWPSDNTQWEEFMRHVEELINQRIADYARNKALAELTGLGNNLDLYIEALDDWKRNPTSQEAKTRVIDRFRIVDGLFEAYIPSFAVSGYQVQLLTVYAAAANLHLLLLRDSTIYGIDWGLSQTNVNDNYNRQIRLTATYANHCTTWYQTGLERLRGSNASSWVTYNRFRREMTLTVLDICSLFSNYDYRSYPAEVRGEITREIYTDPVGVGWVDSAPSFGEIENLAIRAPRTVTWLNSTRISTGTLSGWSGSNRYWAAHMQNFSETNSGNIGFDGPLYGSTVGTIHRTDDYDMGNRDIYTITSQAVLGLWPTGQRVLGVASARFTLRNLFNNLTQVLVYENPISSNFGSSTLTHELSGENSDRPTSSDYSHRLTSITGFRAGANGTVPVFGWTSATVDRNNRLQPDKITQYPAVKGFNLDGFTVVKGTGFTGGNWLRSSRVTGSFRLNVYSPSVQTYRMRIRYASPLGNSTLGISSTDAGISFTSFPLPSTIGSMPSTVPYEAFRVLDIPITVTVASQRNYNFIFDILNPSVGAVYIDRIEFVPVGSSVFEYETK

What is claimed is:

1. A recombinant nucleic acid molecule comprising a heterologous promoter operably linked to a polynucleotide segment encoding a pesticidal protein or pesticidal fragment thereof, wherein:

a. said pesticidal protein comprises the amino acid sequence of SEQ ID NO:119, SEQ ID NO:125, or SEQ ID NO:127; or b. said pesticidal protein comprises an amino acid sequence having
at least 95% identity to SEQ ID NO:119, SEQ ID NO:125, or SEQ ID NO:127.

2. The recombinant nucleic acid molecule of claim 1, wherein:

a. the recombinant nucleic acid molecule comprises a sequence that functions to express the pesticidal protein in a plant; or b. the recombinant nucleic acid molecule is expressed in a plant cell to produce a pesticidally effective amount of the pesticidal protein; or c. the recombinant nucleic acid molecule is in operable linkage with a vector, and said vector is selected from the group consisting of a plasmid, phagemid, bacmid, cosmid, and a bacterial or yeast artificial chromosome.

3. The recombinant nucleic acid molecule of claim 1, comprised within a host cell, wherein said host cell is selected from the group consisting of a bacterial and a plant cell.

4. The recombinant nucleic acid molecule of claim 3, wherein the bacterial host cell is from a genus of bacteria selected from the group consisting of: *Agrobacterium, Rhizobium, Bacillus, Brevibacillus, Escherichia, Pseudomonas, Klebsiella, Pantoea*, and *Erwinia*.

5. The recombinant nucleic acid molecule of claim 4, wherein the *Bacillus* species is *Bacillus cereus* or *Bacillus thuringiensis*, said *Brevibacillus* is *Brevibacillus* laterosperus, or said *Escherichia* is *Escherichia coli*.

6. The recombinant nucleic acid molecule of claim 3, wherein said plant cell is a dicotyledonous or a monocotyledonous plant cell.

7. The recombinant nucleic acid molecule of claim 6, wherein said plant host cell is selected from the group consisting of an alfalfa, banana, barley, bean, broccoli, cabbage, Brassica, carrot, cassava, castor, cauliflower, celery, chickpea, Chinese cabbage, citrus, coconut, coffee, corn, clover, cotton, a cucurbit, cucumber, Douglas fir, eggplant, eucalyptus, flax, garlic, grape, hops, leek, lettuce, Loblolly pine, millets, melons, nut, oat, olive, onion, ornamental, palm, pasture grass, pea, peanut, pepper, pigeonpea, pine, potato, poplar, pumpkin, Radiata pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and wheat plant cell.

8. The recombinant nucleic acid molecule of claim 1, wherein said pesticidal protein exhibits activity against a Coleopteran insect.

9. The recombinant nucleic acid molecule of claim 8, wherein said insect is Western Corn Rootworm, Southern Corn Rootworm, Northern Corn Rootworm, Mexican Corn Rootworm, Brazilian Corn Rootworm, Colorado Potato Beetle, Brazilian Corn Rootworm complex consisting of *Diabrotica viridula* and *Diabrotica speciosa*, Crucifer Flea Beetle, Striped Flea Beetle, or Western Black Flea Beetle.

10. The recombinant nucleic acid molecule of claim 1, wherein said pesticidal protein exhibits activity against an insect species of the order of Lepidoptera.

11. The recombinant nucleic acid molecule of claim 10, wherein said insect is Black Cutworm, Corn Earworm, Diamondback Moth, European Corn Borer, Fall Armyworm, Southern Armyworm, Soybean Looper, Southwestern Corn Borer, Tobacco Budworm, Velvetbean Caterpillar, Sugarcane Borer, Lesser Cornstalk Borer, Black Armyworm, Beet Armyworm, Old World Bollworm, Oriental leaf Worm, or Pink Bollworm.

12. A plant or part thereof comprising the recombinant nucleic acid molecule of claim 1.

13. The plant or part thereof of claim 12, wherein said plant is a monocot plant or a dicot plant.

14. The plant or part thereof of claim 12, wherein the plant is selected from the group consisting of an alfalfa, banana, barley, bean, broccoli, cabbage, Brassica, carrot, cassava, castor, cauliflower, celery, chickpea, Chinese cabbage, citrus, coconut, coffee, corn, clover, cotton, a cucurbit, cucumber, Douglas fir, eggplant, eucalyptus, flax, garlic, grape, hops, leek, lettuce, Loblolly pine, millets, melons, nut, oat, olive, onion, ornamental, palm, pasture grass, pea, peanut, pepper, pigeon pea, pine, potato, poplar, pumpkin, Radiata pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and wheat.

15. A seed of the plant of claim 12, wherein said seed comprises said recombinant nucleic acid molecule.

16. An insect inhibitory composition comprising the recombinant nucleic acid molecule of claim 1.

17. The insect inhibitory composition of claim 16, further comprising a nucleotide sequence encoding at least one other pesticidal agent that is different from said pesticidal protein.

18. The insect inhibitory composition of claim 17, wherein said at least one other pesticidal agent is selected from the group consisting of an insect inhibitory protein, an insect inhibitory dsRNA molecule, and an ancillary protein.

19. The insect inhibitory composition of claim 17, wherein said at least one other pesticidal agent exhibits activity against one or more pest species of the orders Lepidoptera, Coleoptera, or Hemiptera.

20. The insect inhibitory composition of claim 19, wherein said at least one other pesticidal protein is selected from the group consisting of a Cry1A, Cry1Ab, Cry1Ac, Cry1A.105, Cry1Ae, Cry1B, Cry1C, Cry1C variants, Cry1D, Cry1E, Cry1F, Cry1A/F chimeras, Cry1G, Cry1H, Cry1I, Cry1J, Cry1K, Cry1L, Cry2A, Cry2Ab, Cry2Ae, Cry3, Cry3A variants, Cry3B, Cry4B, Cry6, Cry7, Cry8, Cry9, Cry15, Cry34, Cry35, Cry43A, Cry43B, Cry51Aa1, ET29, ET33, ET34, ET35, ET66, ET70, TIC400, TIC407, TIC417, TIC431, TIC800, TIC807, TIC834, TIC853, TIC900, TIC901, TIC1201, TIC1415, TIC2160, TIC3131, TIC836, TIC860, TIC867, TIC869, TIC1100, VIP3A, VIP3B, VIP3Ab, AXMI-AXMI-, AXMI-88, AXMI-97, AXMI-102, AXMI-112, AXMI-117, AXMI-100, AXMI-115, AXMI-113, and AXMI-005, AXMI134, AXMI-150, AXMI-171, AXMI-184, AXMI-196, AXMI-204, AXMI-207, AXMI-209, AXMI-205, AXMI-218, AXMI-220, AXMI-221z, AXMI-222z, AXMI-223z, AXMI-224z and AXMI-225z, AXMI-238, AXMI-270, AXMI-279, AXMI-345, AXMI-335, AXMI-R1 and variants thereof, IP3 and variants thereof, DIG-3, DIG-5, DIG-10, DIG-657 DIG-11, Cry71Aa1, Cry72Aa1, PHI-4 variants, PIP-72 variants, PIP-45 variants, PIP-64 variants, PIP-74 variants, PIP-75 variants, PIP-77 variants, Axmi422, Dig-305, Axmi440, PIP-47 variants, Axmi281, BT-009, BT-0012, BT-0013, BT-0023, BT0067, BT-0044, BT-0051, BT-0068, BT-0128, DIG-17, DIG-90, DIG-79, Cry1JP578V, Cry1JPS1, and Cry1 JPS1P578V.

21. The insect inhibitory composition of claim 16, comprising a plant cell that expresses said recombinant nucleic acid molecule.

22. A commodity product produced from the plant or part thereof of claim 12, wherein the commodity product comprises a detectable amount of said recombinant nucleic acid molecule or a pesticidal protein encoded thereby.

23. The commodity product of claim 22, selected from the group consisting of commodity corn bagged by a grain handler, corn flakes, corn cakes, corn flour, corn meal, corn syrup, corn oil, corn silage, corn starch, corn cereal, whole or processed cotton seed, cotton oil, lint, seeds and plant parts processed for feed or food, fiber, paper, biomasses, and fuel products such as fuel derived from cotton oil or pellets derived from cotton gin waste, whole or processed soybean seed, soybean oil, soybean protein, soybean meal, soybean flour, soybean flakes, soybean bran, soybean milk, soybean cheese, soybean wine, animal feed comprising soybean, paper comprising soybean, cream comprising soybean, soybean biomass, and fuel products produced using soybean plants and soybean plant parts.

24. A method of producing seed comprising:
   a. planting at least a first seed according to claim 19;
   b. growing a plant from the seed; and
   c. harvesting seed from the plant, wherein said harvested seed comprises said recombinant nucleic acid molecule.

25. A plant resistant to insect infestation, wherein the cells of said plant comprise the recombinant nucleic acid molecule of claim 1.

26. A method for controlling a Coleopteran or Lepidopteran species pest or pest infestation, said method comprising:
   a. contacting the pest with an insecticidally effective amount of a pesticidal protein as set forth in SEQ ID NO:119, SEQ ID NO:125, or SEQ ID NO:127; or
   b. contacting the pest with an insecticidally effective amount of one or more pesticidal proteins comprising an amino acid sequence having
      at least 95% identity to SEQ ID NO:119, SEQ ID NO:125, or SEQ ID NO:127.

* * * * *